United States Patent 11,098,302 (IDENTIFICATION OF POLYNUCLEOTIDES ASSOCIATED WITH A SAMPLE) - sequence listing, part 95

SEQ ID NO: 327897 - DNA, 609 bp, Homo sapiens
  misc_feature: GZ8MTXP02GGCSA.17.4.A04.1.454.CMB.2.raw
  modified_base (236)..(236): a, c, t, g, unknown or other
  misc_feature (236)..(236): n is a, c, g, or t
  modified_base (351)..(351): a, c, t, g, unknown or other
  misc_feature (351)..(351): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctcctgcatagtgataggaaanccttattgtattggtacctgacagaaggcaggccagtctcacatctactaatctatgaagtttccagtcattctcgtggatgaccagtagttaggttcaggtggcaggcgggtanagggcacgagtacttcaacacgtaagaaaagtcgaaggccggggtaggacggtgtaggaaggtagtttagggtttaggggtttaattacgttagactagtagtacgttaaacggtttcttttacccggtacgttacggtacggtttaccggaaccggtaaacggggtaaaccggtaaaagggttaacggtaaaaccttacgaaaaccgaaacggtaaaacggttagggcgggtacctacggaccgtaaacccgttacg

SEQ ID NO: 327898 - DNA, 586 bp, Homo sapiens
  misc_feature: GZ8MTXP02HLB3O.17.4.A04.1.454.CMB.2.raw
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctcctgcaagtctagtcagacgcctcctgcatagtgatggaaagtacctattgtattggtactgcagaagcagcagtctcacatctctaatctatgaagtttccagtcgtattctccgtggagtcgaccagtacgttagttcgaagtcggcaggccggggtanaggacacgtaagtatttacaactactaagaaaaactcgaagggtccggggtagggacggngtaggaagggtagtttgggttttaggggtttattacggtgtacgtagtagaactaaagtatacgtagtaccttacgtacttacgtttcgggaccgtaaacggggtaccaaggtacgtagggaacgtaacgttaaaccgaaaacggtaacgttacggtacggtaccgtaccgg

SEQ ID NO: 327899 - DNA, 622 bp, Homo sapiens
  misc_feature: GZ8MTXP02G1T7B.17.4.A04.1.454.CMB.2.raw
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgctatagtgataggaaactacctatttgtattggtacctgacagagcaggccagtctcanatctactaatctatgtaattccagtcgtattcncgtggatcgactaagtagttaggtccaggtggcgagggtcgggtcagggcaacgagtacttacaactacgtaagaaaactcggacggtaccggggtaggaacggaccgggtaaaggtagtttaaggtttacgggggtttaatacgttagacgtagttaggtacgttaaggtttactttccgttccggtaagggtaccggtttacggaaaccggaacgggtaacccgtaaaggggtaacgtaaacgttacccgaaacggaaaccgtaacggtcggtacggtaccggtacgcctaaccgttacgtttaccg

SEQ ID NO: 327900 - DNA, 694 bp, Homo sapiens
  misc_feature: GZ8MTXP02HFLDO.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtccgtcaccctggacagccggcctccatctcctgcaagtctagtcagagcctcctgcataggtgataggaaagtcctattgtattggtacctgcagaagcaggccagtctccacatctacctaatctatgtaagtttccagtcgtattctccgtggagtcgacctaggtagttagggttcagggttggacgtagggtccggggttacgagggccaacgtaggtactttacgaaccgtaacgtaagaaaacgtaccggacggggtacccggggtaggggaacgggtcggttaagggaaaggggttaagtttaaggtttagggggtttttaacttacgttaggacgtaagttacgggtaacgttaacggggttttaacgtttttacccgtttccgggtaccggggtttaacccgggttaccgggtaacccggaaaacggggtaaacccggtaaaaggggttacggtaaaacgtaccgtaaaccgaaccggtaaacgtacggtacgggtacttacggaacctaccgttaacg

SEQ ID NO: 327901 - DNA, 605 bp, Homo sapiens
  misc_feature: GZ8MTXP02I7XXC.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagccggcctccatctcctgcaagtctagtcagacgtcctcctgcatagtgaataggaaataccttatttgtattcggtacctgacaggaaggcaggccagtctccatctcctacctaatctatgtaactttccagttcgatttctcgtggatcgacctaggtacttaggttcgaggtgggacaggggtcggggtacaacgggcaaacgagttactttacaacaacgttaagaaaactccggaagggtccggggtggacgggtcgtagggtaggtaagtttagggtttacggggtttaattacgtgtacgtagtaggtacgttaaaggtttcttttcccgtcggtaggtaccgttcgggaccgtaacgggtaccgaaaggtacgaaaactcgaacgaacgtacgtgtacggctacgctacttacg

SEQ ID NO: 327902 - DNA, 632 bp, Homo sapiens
  misc_feature: GZ8MTXP02I2DEL.17.4.A04.1.454.CMB.2.raw
  modified_base (180)..(180): a, c, t, g, unknown or other
  misc_feature (180)..(180): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacngccggcctccatctcctgcaagtctagtcagagcctcctgcatagtgatggaaagtaccttattgtaattggtacctgcgaaggaaggcacggccagtcctccacactcctacctaatctattgtaacgtttccagttctatttctcgtggagtcgaccaggtacttggtcgaggtcggcgaggtcggggtacagggcaacgtagtacttacacaacgtaagaaaacgtcgagggtccgggtagggaggacgtaggaaggttagttaggttttaggggtttacttagtgactagttacgtacggttaaacggtttcgttttacccgtacgggttcggttaaccggttccggtaaccggaaacggggtaaaccggtaaaggttacggtaaaaccgttaccgaaacgtaaccggtaaacgttcgggtacggtacgtacgaccgtacctttaacg

SEQ ID NO: 327903 - DNA, 569 bp, Homo sapiens
  misc_feature: GZ8MTXP02I5VBN.17.4.A04.1.454.CMB.2.raw
  modified_base (275)..(275): a, c, t, g, unknown or other
  misc_feature (275)..(275): n is a, c, g, or t
  modified_base (414)..(414): a, c, t, g, unknown or other
  misc_feature (414)..(414): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagacgcctcctgcatagtgataggaaatacttattgtattggtacctgacagaggcaggcagtctcanatctactaatctatgtacttcagtctattctcgtggatcgactagtagttagttcgaggtcggacgtagggcgggtacacgggacaacgtagttactttacaactaacgtaagaaaatcgaaggccggggtaggacggngtaggaagtagtttaggtttagggtttaatacgtagacgtgtacgtacgttaaagtttcgtttaccgtcggtacggtacggttacggaccgtaaacgggaacgtaaaggttacgaaactcgaaacgaacgtaacgtgtcgactacgacacttacg

SEQ ID NO: 327904 - DNA, 548 bp, Homo sapiens
  misc_feature: GZ8MTXP02HCDG9.17.4.A04.1.454.CMB.2.raw
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgataggaaanaccttatttgtaattggtacctgcagaagcaggccagtctcanatctacctaatctaatgaagtttccagtcgtattctcgtggatgccagattagttcagtggcaggcgggtacagggacacagtatttacaacaactagaaaatcgaaggccggggtggaggcgtaggaggtaagttagtttaggggtttaacttagtagagtagtagtacgtaaaggttacttttccgttcgtacggtacgttcggtacgaaacgggaaccgaaaggtagaaactacgaacaacgtaacgtcgtagatacgacacctac

SEQ ID NO: 327905 - DNA, 588 bp, Homo sapiens
  misc_feature: GZ8MTXP02FGX0V.17.4.A04.1.454.CMB.2.raw
  modified_base (326)..(326): a, c, t, g, unknown or other
  misc_feature (326)..(326): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagagcctcctgcatagtgataggaaagtacctatttgtaattggtaaccctgacaaggaaggcaaggccagtcctaccacattcctacctaatctatgtaagtttccagtcgtatttcncgtggagtgaccagtattagggttcaggtggcaggcgggtcagggcacgagtactttacaactactaagaaaatcgaacgggccggggtagggaggcgtaggaggtagttaggtttaggggtttattacgtgactagtgacgttaagttactttccgttcggtggtacgttcgggaccgtaaacgggaaccgtaaagggtacgtaaaactaccgaaacgaaccggtaaacgtcggtacggacgtacggaccgaccgttaacg

SEQ ID NO: 327906 - DNA, 676 bp, Homo sapiens
  misc_feature: GZ8MTXP02J19CQ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtcaccctggacacgccggcctcatctcctgacaagtctagtcagacgccctctgctatagtgaatagggaaatccttatttggtaattcggacctggacaaggaacggcaggcctagtcctaccatatcctactaatctatgtaacgttccagttcattctcgtaggatcgacctagtagttacgggtcagggtcgcagggtcgggtacagggacaacgtagtacttacaactaactaagaaacgtcgaacggggtcgggtaggacggtagtagggtaaggttagtttagggtttaggggtttaacttacggtaggtactaaggttacggtaacgtttaaacgggttttccgttttacccggtacgggtacggggttaaccggtttaccgggaaacccggtaaaacgggggtaaacccttaaagggggtacgtaaaaaccgttacccgaaacggaaccgttaaacgggttcggtacggggttaaccctaccggtaacctaccgtacg

SEQ ID NO: 327907 - DNA, 552 bp, Homo sapiens
  misc_feature: GZ8MTXP02F8DTE.17.4.A04.1.454.CMB.2.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctcctgcatagtgataggaaanacttattgtattggtacctgcagaggcaggccagtctcacatctacctaatctatgaactttccagtctattcncgtggatgaccagtattaggtcgagtggcaggtcgggtnaggcacgagtattacacactagaaactcgaggccggggtggacgtcgtaggtaggtagttaggtttaggggtttattacgtgactagtagacgttaaggtttactttccgttacggtcggtacggttaccggtaccggtaaacgggtaccgaaggtacgaaactcgaacgaacgtaacgtggtacgacgtacgacgtactacg

SEQ ID NO: 327908 - DNA, 583 bp, Homo sapiens
  misc_feature: GZ8MTXP02FHJ43.17.4.A04.1.454.CMB.2.raw
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (462)..(462): a, c, t, g, unknown or other
  misc_feature (462)..(462): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgacgaagactactnttntgtacgtcgngacgagacgagacgctactccacatctacctaatactatacgtaagttaccgttacgtcgaacttcttctacggtagtacgcgacgtagtaggttacgtaggcggtacggaggtcggggcgtaagcgtacagatttacactaactacggaaaatacgacgcggggtagggagacgtgaaagggtattaagtttggggtttattaacgngtgactgtagtacggtttaactttccgttccggtggtaccggttcgacccggaaacgggtaccgaaagggttacgaaaacgtacacgaaacgaacgtacgtgggtctacgtcaccagttcg

SEQ ID NO: 327909 - DNA, 706 bp, Homo sapiens
  misc_feature: GZ8MTXP02JXHLJ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtccgtcacccctggacagccgcctccatctcctgcaagtctagtcagacgcctcctgcatagtgagtaggaaagtaccttatttgtagttggtaacctgacaaggaacggcaaggccagtcctccacacttcacctaatctatagtaactttcagtcgtattctccgtggatcgaccagtagtaggttcaagggtcggcgtagggccgggtacacgggtacaacgtaacgtaatttaccgaactaacctaaagtaaaacgtccggaaggggtacccgggggttagggaacgggtcgtagggtaaggttaaggtttaggttttagggggtttaattacggtagtacgtagttacggtacgttaaggttttaccgtttttaccgttccgggttaacgggtttaccgggttaaccggggtaaccgggttaaaacgggggaaaacccggttaaaacgggggttaacggaaaaccgttaaccggtaaaccggaaacccggttaaagtacgggtacgggtaaccgtcggttaaccaacctttaccgg

SEQ ID NO: 327910 - DNA, 502 bp, Homo sapiens
  misc_feature: GZ8MTXP02GVKXS.17.4.A04.1.454.CMB.2.raw
  modified_base (236)..(236): a, c, t, g, unknown or other
  misc_feature (236)..(236): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggtacctgcagaaggcaggccagtctcacatctcctaatctatgaagtttccagtcgattctctggagtgcagataggttcagtggcagcgggtcagggcacagatttcacactgaaaaatcagccggggtggaggctagaggatatttgggggtttaattacgtgcatgcaaggtattttccgttccgttggacgttcggtcgaaacggacaaaggtacggaaatacacaacgaacgtgtggactgcaccta

SEQ ID NO: 327911 - DNA, 658 bp, Homo sapiens
  misc_feature: GZ8MTXP02FVKC5.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgataggaaagtacttatttgtattggtacctgacagaaggcaggccagtctaccacatctacctaatctatgtaagtttccagtcgtattctcgtggatcgaccagtagttacgggttcaggtggacaggcggggtacagggcacgagtactttacgaactaactaagaaaacgtcgaacgggtccggggtagggagggtcgtagggaagggttaagtttaagggtttagggggttttaatttaaccggtggtacctaagttacggtaacggtttaaacgggtttaccgtttttacccgtttaccgggttcggggtaacccggtttaccgggaaccgggtaaacgggggtaaaccggtaaaggggttacgggtaaaactaccgaaacgtaaacggtaaaccgtgggttacgacgttacggacctacgttacg

SEQ ID NO: 327912 - DNA, 628 bp, Homo sapiens
  misc_feature: GZ8MTXP02IEVHN.17.4.A04.1.454.CMB.2.raw
  modified_base (315)..(315): a, c, t, g, unknown or other
  misc_feature (315)..(315): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagaccttatttgtattggtacctgcagaaggcaggcagtctcacatctcctaatctatgtaagttccagtcgtattctccnggtagtgccagtagtggttcgagtggaccagcggggtcagggcaacgagtactttcaactacgtaagtaaaacgttcgaaacgggtcccggggaggggttaacggggtacggtaggtaaggttaggtttaacgggttttaggggtttaacttacgtacgtacgtagtagtacgttaacggttttacgttttaccggttacggttacgggttaccgggttacgggaaccggtaaaacgggtaaccggtaaacgggtaacggtaaacgtacgaacgtaacggtaacgtacggtacgtacgtacgtacctacgtcg

SEQ ID NO: 327913 - DNA, 550 bp, Homo sapiens
  misc_feature: GZ8MTXP02JN9WO.17.4.A04.1.454.CMB.2.raw
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (361)..(361): a, c, t, g, unknown or other
  misc_feature (361)..(361): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctcctgcaagtctagtcagagcctctgcatagtgatggaaanacctattgattggacctgcagaagcagcagtctccanatctcctaatctatgaagtttcagtcgatctcctggatgccagactaggttcagtgcagcggtcaggcacagtattcgaacactagaaaanacagcgggtggacgtagagagtagtagttagggtttagttacgttagcgtatagtacgtaaggttacgttttaccgtttccggttacggtacggttacggtaccggtaaacgggaacccggtaaacgggttaggaaacgtaaccgaacgaacgtaaccgtaacggtaggtacgtcgtacgaccgtaacg

SEQ ID NO: 327914 - DNA, 822 bp, Homo sapiens
  misc_feature: GZ8MTXP02G6HEW.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtcctccaccctggacacgccgcctcactctcctgacaagtctagtcagacgcctcctgactagtagtgaagtaggaaacgtacttagtttagtagttcggtacctgacgaaggaacggcgaacggtccacgttcctacccaatacttaccttacctaaattcctaaagttacggttaacgttttcccgaagtttaccgtaacgttttccgtaccggttagggtacgttcggaaccgttaaggttaaacgtttacggggttaccgtaaggggttcgggaaccggtacggggtcccggggtacgaacgggtaaccgaaacgtaaacgttaactttaaccgaacctaaacgttaaacgtaaaaacgtccgggaacggggtacccgggggtaagggacgggtacgttaaaggggtaaaggtttaaaggtttaaggggtttttaggggttaaactttaccggtaggtaaccgttaaggttacggttaacgttttaaacgggttttccgtttttacccggttacgggttacgggtttaaccggtttaccggggaaacccggtaaaacggggtaaaccgttaaaggggttaacgtaaaaccgttacgaaaaccggtaaacggtaaccgttgggtacgtaccgtacgtaaccgtaaaccgtttcg

SEQ ID NO: 327915 - DNA, 563 bp, Homo sapiens
  misc_feature: GZ8MTXP02HVNZA.17.4.A04.1.454.CMB.2.raw
  modified_base (311)..(311): a, c, t, g, unknown or other
  misc_feature (311)..(311): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgtattggtacctgcagaagcaggccagtctccacatctacctaatctatgtaatttccagtcgattcnctggatcgcagacttaggttcaggtcggctagggcgggtcaggcacgagattcacactagaaaactcgacggccgggtgggaggcgtaggaggtagttaggttttagggtttatttacgtgtacgagtgtacgtaaggtttacttttccgttccggttaggtacggttacggaccggtaaacgggtaaccgtaagggtacggtaaactaccgaacgtaacgtaacgtggtcggtcgtacgaccgtaactacg

SEQ ID NO: 327916 - DNA, 582 bp, Homo sapiens
  misc_feature: GZ8MTXP02JUK4Y.17.4.A04.1.454.CMB.2.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaancctattgtattggacctgcagaaggcaggccagtctccanatcncctaatctatgaactttccagttcattctcgtggatgccagatagggttcagtggctagcgggtcaggcacagtattcacactagaaaatcgaacggcgggtaggacgcgtaggaggtagttaggtttggggtttatacgtgtacgagttacggactaaagggtttcttttaccgtttaccggtcgggttaaccggtttccgggaccggtaaacgggggtacccgtaaagggttaacgggaaaactaccgtaaccgaacgtaaaccggttacgggtacggtaccgtacggtacctaccgtacg

SEQ ID NO: 327917 - DNA, 620 bp, Homo sapiens
  misc_feature: GZ8MTXP02JLAZ6.17.4.A04.1.454.CMB.2.raw
  modified_base (397)..(397): a, c, t, g, unknown or other
  misc_feature (397)..(397): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtcccgtccaccccgtggaccacgcccggccctccattcctcctgactaagtctagtcagactcctctgacatagtcgataaggaaataccttagtttggtaattcgggtacctgacgaaggaaggccaaggtccacgtcctaccactactacctactaatacctattacgtacgttcagttgtatctcgtggagtcgacctagacgttagttcgaggtgcgtaggcgggtanagcacagtactacgaactactaaagaaagtccgaaggtcggggtaggagtacgtagggtaagtaagtttaggtttacgggtttaattcggatacgtagtacggttacgtaagttttccgttttaccgtcggttacggttaccggtacggtaccggaaacgggtaaacgtaacggtacgaaacttcgaaacgaaccgaagttaggacgtcacgtaccacttacg

SEQ ID NO: 327918 - DNA, 632 bp, Homo sapiens
  misc_feature: GZ8MTXP02HAX3Q.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagccggcctccatctctgcaagtctagtcagagcctcctgcatagtgagtaggaaacgtaccttagtttgtaagtttgggtaacctgacaaggaaggccaaggcctagtcctccactatcctacctaattcagtcgtaagtttcccaagttcattctccgtggtacgtcgacctaaggtacgtaggtttcgagtcggacgtaggtccgggtacagggactaacgagttaactttcaaacgtaacgttaaagaaaagtcggacgggttaccggggaggacggtcgtagggtaagttagttagggtttacggggtttattacgtgacgtagttacgtacgttaaaggttcctttacgtcggtcggtaacgttcggaacgtaaacggggaaccgtagggtaacgaaactcgaaccgtaagtaaccgtaggtccgtacgacggtaccacgttacg

SEQ ID NO: 327919 - DNA, 549 bp, Homo sapiens
  misc_feature: GZ8MTXP02IZZ23.17.4.A04.1.454.CMB.2.raw
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (417)..(417): a, c, t, g, unknown or other
  misc_feature (417)..(417): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagccctcctgcatagtgatggaaagacctattgtattggtacctgcagaggcaggcagtctcncatctcctaatctatgaagtttccagttcattctctggatgcngtataggtcagtggcagcggtcagggctacngtattacacactaaggaaacttgaacggcgggggtagacgacgttgaggtattagttgggggttttanagtagcgatcggtactaacgggttattttccgtccggttgggtaaccgttcgggaccgtaaacgggaccctaaaggggttacgaaacgttacccgacgtaacggtaactaggtcggtacctcgacacccgta

SEQ ID NO: 327920 - DNA, 595 bp, Homo sapiens
  misc_feature: GZ8MTXP02JIMT6.17.4.A04.1.454.CMB.2.raw
  modified_base (283)..(283): a, c, t, g, unknown or other
  misc_feature (283)..(283): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtccgtccaccccgtggacagcccggcctccattcctcctgcaagtctagtcagacgcctcctgcatagtagaacggaaagtcctagtttgattggtacctgcagaggcaggccagtcnccatatctacctatctatgtaacgttcagtcgtattctgtggatcgcagtagttacggttcagggtcgacggacgggtccgggtagaacggtacaacgtacgtactttaccaacgtaacgtaagaaaaacgttcgacggggtccggggttagggaaggcgtaggaggtagttaggtttaggggtttatacgtgacgtagtagtacgttagtttactttccgttcggtacggtacgttccggacgaagggaccgtaaaggtacgtaactacgacgaacgtaacgtggtacgtacgtacgacctaacgtcttcg

SEQ ID NO: 327921 - DNA, 616 bp, Homo sapiens
  misc_feature: GZ8MTXP02JL8UO.17.4.A04.1.454.CMB.2.raw
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (466)..(466): a, c, t, g, unknown or other
  misc_feature (466)..(466): n is a, c, g, or t
tcagcgtagactagcacgaccggtgctcgatttagagtagtgatcaggacttctcagttcatcttctcaccatgaggctccctgctcagctccgtggggctgctaatgctctggatccctggatccagtgcgtatattgngatcgacccagacctccactctctctcgtccgtaccacccgtggacncgccgcctcatcctactgactaagtctagtcagacgtcctcgtnactaatggtacaagtaaggaaactctttagttcgtagttcgacctgntaaggacggcaacgctacgctacatctctacgtatcaagttgtactccagtcctatctggngacncgtacgatgttcggtgcgtggcgagcggtacactacagtagtacctacgagtaaataaacgtaacgtcgggacggtacgggtagtacgtcgtaaaggtagttaggttttaacggttgtttaanacgtgaacgttacgtaagttacgttaacggtttccgtttaccgtacggtaccggttacggtacggaaaccgggaacggtaaaccggtaaagtaaaccgtaacgaccgtaaacgaacggttagtcgggtactaccgtacaccgttacgtcg

SEQ ID NO: 327922 - DNA, 552 bp, Homo sapiens
  misc_feature: GZ8MTXP02I7XBC.17.4.A04.1.454.CMB.2.raw
  modified_base (313)..(313): a, c, t, g, unknown or other
  misc_feature (313)..(313): n is a, c, g, or t
  modified_base (444)..(444): a, c, t, g, unknown or other
  misc_feature (444)..(444): n is a, c, g, or t
tcagcgtagactagcacgaccggtgctcgatttagagtagtgatcaggacttctcagttcatcttctcaccatgacggctccctgctcagctcctggggctgctaatgctctggatccctggatccagtgcggatattgtgatgacccagactccactctctctgtccgtcaccccctggacagccggcctccatctcctgcaagtctagtcagagcctcctgcatagtgataggaaagacctatttgtattggacctgcagaaggcaggcagtctccacatctacctaatctatgaatttccagtcgattcnctggattgccagacttagggttcaaggtcgggacaggcggggtacaggggcacgagatttcgacactagaaaatcaggccggggtagaggcgtaggaggtagttagtttagggggtttacttaagtgtacntagacgtaaggtttatttccgttcgttggtaccggttcggtaccgaaacgggtacgaagggtgaaaattccgaactaacgtaacgtaggtggactcggacaccgtaac

SEQ ID NO: 327923 - DNA, 647 bp, Homo sapiens
  misc_feature: GZ8MTXP02JBKJH.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctcactctctctgtcccgtcacccctggacagccgcctccatctcctgcaagtctagtcagagccctctgcaatagtgataggaaagtaccttatttgtattggacctgacagaggcagccagtctcacatcactaatctatgtaacgtttccaaggtctaaagtttctccgtggtagtcgaccgaagtagttaagggtttccgaagggttgggaccgacgggtccgggtacgaaaggccaaccgaagtactttaccaacgtaacttacgtaaaaagttccgaacgggttaccggggtacgggaaggggtcgtaaaggttaagggttaaacggtttagttttagggggtttattaacgtttgtacgttagtacgtacgttaaagggtttctttaacgtttccgggtcggtacggttccggacggtaaacgggacgtaacggtacgtaaacgtacgaacccgaagtaaccggtagtcgggtactcgtcaccttaacg

SEQ ID NO: 327924 - DNA, 643 bp, Homo sapiens
  misc_feature: GZ8MTXP02JC0VS.17.4.A04.1.454.CMB.2.raw
  modified_base (381)..(381): a, c, t, g, unknown or other
  misc_feature (381)..(381): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagcgcctcctgcaatagtgacttaggaaataccttattgtaattgggtacctgacaggaggcaggccagtctcacatctctaatctatgaagtttccagtcgtattccgtactgggactcgcctaagtacttacggggtttcaagggttcgggactacgggcccgggggttaanacgggacctaacgtagttacttacgaacgtacgtaacgtaaaacgtccgtacgggtacggggtaggaggtacgtagggaggttagtttagggtttagggtttagttacgtacgacgtagttacggtacgttaacggtttccgttttaccgtacggttacggttaccggttaccgggaaccggtaaacgggtaaccggtaacggtacgtaaaccgtaccgaacggtaacgtacgtacggtacgtacgtacgtaccgtactacg

SEQ ID NO: 327925 - DNA, 728 bp, Homo sapiens
  misc_feature: GZ8MTXP02H40D4.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatcctggatccagtgcggatattgtgatgacccagactccactctctctgtccgtcacccctggacacgccggcctcatctcctgcaagtctagcagacgcctctgacagtagtgaataggaaactccttattgtattcggacctgacgagaacggcacggcagtctcacatctactaatctatgtaacttcaagttctattctcgtaggagtcgactagtagttagttcgaggttcgacgagggtccggtacgacggtaccaaacgtagtactttacgaaacgttacgtaaaagtaaaacgttccgggaacgggggtaaccgggggttagggtacgtacggttagggtaaaaggggttgttttaaagggggttttttaggggtttaaactaccgggtttacgtaacgtaggtttaaaccgggtaccggttttaaaaacggggtttttacccttttttccggggttacccgggtttaacgggggttaaacccgggtttacccggggtaaacccgggtaaaacggggtaaccgtaaaagggggtaactaaaaccgttaccgaaaacgttaacgggaaacgtttcggaacggtctaaaaccggccgttaaacgtcgg

SEQ ID NO: 327926 - DNA, 678 bp, Homo sapiens
  misc_feature: GZ8MTXP02JO9CX.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatcgacccagacctccactctctctcgtcctccacccgtgacacgccgcctccatcctctgactaacgtctagtacagacgtccttcgtgactagtagagaagtaaggaaacttctttagttgttagttcggtaccgtgacgaaggaacggcgacggtactacgtcctaccactctacctacgtatacgtatagttacttcagtctacttctgtgagtcactagtaagttgttcgagggtcggcggacggcggtacgacgtacgtaatacgtacttacaaactagtaaacgaacgtcggacgggtacgggagaaggtcgtaaggaaggtttacgttaggtttagggtttatacggtactagttaacggtagttaacggtttaacgttttaccgtttccggttaccggttacggttaaccggttcgggtaaaccgggaaacggggttaaacggtaaacggggtaaaccgtaaacgtaaccgtaacggtaacggttacggttaacggtccggtacgtaacccgtacggtaaacctttcgg

SEQ ID NO: 327927 - DNA, 463 bp, Homo sapiens
  misc_feature: GZ8MTXP01CG9N6.2.46.E02.1.454.CMB.2.raw
  modified_base (388)..(388): a, c, t, g, unknown or other
  misc_feature (388)..(388): n is a, c, g, or t
  modified_base (459)..(463): a, c, t, g, unknown or other
  misc_feature (459)..(463): n is a, c, g, or t
tcagacgctcgacacacgaccggtgctcgatttagactcatctacagggaaagggctggagtggattggggaaatcaatcattttcgaggcaccacttacaacccgtccctcaagagtcgagtcaccattgcagtggacaggtccaagaaccagttttccctgaacttgaactctgtgaccgccgcggacacggctgtgtattactgtgcgagaggcgaattacccggtactgcgacacaccaagatcagctggtccgaaggctacttcgttactacggcatggacgtctggggccaagggaccacggtcaccgtctcctcagcctccaccaagggcccatcggtcttccccctggcaccctctccaacgagcacctctgggggcacngcgccctggggctgcctggtcaaggctacttcctgtcgagcgtctgagcgggctgggcaaggcggcatagnnnnn

SEQ ID NO: 327928 - DNA, 513 bp, Homo sapiens
  misc_feature: GZ8MTXP01AP3JY.2.46.E02.1.454.CMB.2.raw
  modified_base (163)..(163): a, c, t, g, unknown or other
  misc_feature (163)..(163): n is a, c, g, or t
  modified_base (200)..(200): a, c, t, g, unknown or other
  misc_feature (200)..(200): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (458)..(458): a, c, t, g, unknown or other
  misc_feature (458)..(458): n is a, c, g, or t
  modified_base (504)..(513): a, c, t, g, unknown or other
  misc_feature (504)..(513): n is a, c, g, or t
tcagacgctcgacacacgaccggtgctcgatttagactcatctacagggaaaggggctggagtggattggggaaatcaatcattttcgaggcaccacttacaacccgtccctcaagagtcgagtcaccattgcagtggacaggtccaagaaccagttttcccngaacttgaactctgtgaccgccgcggacacggctgtntattactgtgcgagaggcgaattacccggtatgcgacacacaagatcagctggtccaaggtcttacttcgttactacggcagtggacgtcgtggggccaagggaccacggtccaccgttcncctcacgcctccaccaagggccccagtcccggttcttcccccgnggccaccctcctaccaacgcgcaccgtcgtgggggacccacgcggccgccccgtggggcctcggccctgggtaccaaggtacctacttcccgngttaccgagcgtcgtgaggcgggctcgggcgaacggcggcagtagnnnnnnnnnn

SEQ ID NO: 327929 - DNA, 521 bp, Homo sapiens
  misc_feature: GZ8MTXP01EI5DQ.8.88.H11.1.454.CMB.2.raw
  modified_base (208)..(208): a, c, t, g, unknown or other
  misc_feature (208)..(208): n is a, c, g, or t
  modified_base (498)..(498): a, c, t, g, unknown or other
  misc_feature (498)..(498): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagagtagttatttagcctggtatcggcaaaacctggccaggctccccgactcctcttctttggtggagcctacagggccactggcaccccagacaggatcagtggcagcgggtctggggacagacttcaattctcaccatcaacagactgcagcctgaagatattgactagtttacactgtcagcagtatgttacgtcccgtggacgttcggaccagggaccaaggtggacaatcaacgaacttgtggctgcaccnttctgtctcatcttccgcaatcg

SEQ ID NO: 327930 - DNA, 522 bp, Homo sapiens
  misc_feature: GZ8MTXP01ET5T6.8.88.H11.1.454.CMB.2.raw
  modified_base (210)..(210): a, c, t, g, unknown or other
  misc_feature (210)..(210): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccacccttgtctttgtctccgtgggggganagccaccctctcctgcagggccagtgaaccttttagagtagttatttagcctggtatcggacaaaactggccaggcctccccgactcctcttctttggtggagcctacagggccactggcaccccagacaggatcagtgcaggcgggtctgggacagacttcaattctcaccatcaacngactgcagctagaantattgactagtttactactgcagctagttagtgttaccggtcccgtggacgttcggacgtaaggaccaggtgacatcaacacttgngctgcacgttnttcntctcntcttctcgttcn

SEQ ID NO: 327931 - DNA, 569 bp, Homo sapiens
  misc_feature: GZ8MTXP01CCIU3.8.88.H11.1.454.CMB.2.raw
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagtagtagttatttagcctggtatcggacaaaactggccaggctcccgactcctcttctttggnggagcctacaggggcccactcggccaccccagacaggatcagtggcaggcgggtcctggggacagacttcaattcncaccatcaacagactgcagctgaagatattgactagtttacactgtcagcagttatgttaccgtcccgtaggtacgttccggacgaagggaccaaggtcggactaagaccaaaccggtaacttggtacggcgtacgccaccgttattcgttaagtccttcacgttccttcccgtccttaagttccg

SEQ ID NO: 327932 - DNA, 528 bp, Homo sapiens
  misc_feature: GZ8MTXP01DMV59.8.88.H11.1.454.CMB.2.raw
  modified_base (210)..(210): a, c, t, g, unknown or other
  misc_feature (210)..(210): n is a, c, g, or t
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagctcgcgtgtccacgaccggtgctcgatttagcgacagcgagaacacacaaagggggggagaagagctgctcagttaggacccagagggaaccatgtaaagcccagcgcagcttctcttcctcctgctactctggctcccagagacgaccggagatattgtattgacgcagtctccaaccaccctgtctttgtctccgtgggggganagccaccctctcctgcagggccagtgtaaccttttagtagtagttattagcctggtatcggcaaaaactggccaggctccccgactcctcttctttggtggagcctacaggggccactggcaccccagacagggatcagtggcagcgggtctgggacagacttcaattctcaccatacaaacagactgcagcctgaacgattattgactagtttactactgtcagctagtatcgttacgtcccgtggacgttcggaccgaaggaccaggtggcaatcaacgattgtgctgcacnttctgtcttcatccttcctcntcg

SEQ ID NO: 327933 - DNA, 650 bp, Homo sapiens
  misc_feature: GZ8MTXP01B25FU.8.88.H11.1.454.CMB.2.raw
  modified_base (210)..(210): a, c, t, g, unknown or other
  misc_feature (210)..(210): n is a, c, g, or t
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctcccaaccaccctgtctttgtctccgtgggggganagcccaccctctcctgcgagggccagtgtaaccttttagtagttagttatttagcctggtatcggacaaaacctggccaggcctccccgacttcctcttcgtttggnggacgccctacgacggggcccacgtcgggaccacccccgagaccagggatcgaggtggcaggcgggtctggggacagtacttcaattcctcaccatcaacgagacctgacagcctagaagnttattgactagtttacactgtacagtctaggttacgttcggtttacccggtccccggttagggtacccggtttaccgggaccgtaaacggggaacccgtaaaggggtcgaaccgtaaacgtccgaaaccggtaacgttgggtcggttcgtcggaccacccttagttccgttcgttcccttaactacgttcccttccccgccttaacgttccg

SEQ ID NO: 327934 - DNA, 533 bp, Homo sapiens
  misc_feature: GZ8MTXP01AT1WU.8.88.H11.1.454.CMB.2.raw
  modified_base (209)..(209): a, c, t, g, unknown or other
  misc_feature (209)..(209): n is a, c, g, or t
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagtagtagttatttagcctggtatcggcaaaactggccaggctccccgactcctcttcttggtggagcctacaggggccactggccaccccagacaggatcagtggcaggcgggtctggggacagacttcaattctcaccatcaacagactgcagcctagaagatattgctagtttactactgtcagcagtatgttaccgtcccgtggacgttcggccgtaagggaccaagggtggacaagtcaaaccgaattggtggctgcaccnttctgtcttcatccttccgcntcg

SEQ ID NO: 327935 - DNA, 537 bp, Homo sapiens
  misc_feature: GZ8MTXP01AXFLR.8.88.H11.1.454.CMB.2.raw
  modified_base (209)..(209): a, c, t, g, unknown or other
  misc_feature (209)..(209): n is a, c, g, or t
  modified_base (509)..(509): a, c, t, g, unknown or other
  misc_feature (509)..(509): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagagtagttatttagcctggtatcggcaaaacctggccaggctccccgactcctcttcttggtggagcctacagggccactggccaccccagacaggatcagtgcagcgggtctgggacagactcaattctcaccatcaacagactgcagcctagaagatattgactagtttacactgtacagctagtagtgttacgtccccgtggaccgttcggacgtaagggaccaaggtggacaatcgaaacgaacgttgtcggctgcaccgnttctgtcttcactccttcccgcaactcg

SEQ ID NO: 327936 - DNA, 667 bp, Homo sapiens
  misc_feature: GZ8MTXP01CDPUP.8.88.H11.1.454.CMB.2.raw
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagtagttattagcctggtatcggacaaaactggccaggcctcccgactcctcttcttggnggagcctacgagggccactggccaccccagacaggatcgagtggcaggcgggtcctggggacagaccttcaattccncaccatacaacagactgcagcctagaagatattgctagtttactactgtcagctaagttacgttacggtttacccggttcccccggtagggtacccggtttaccgggacccgtaaaacgggggtaacccgaaacggggttacgggaacctaaacgttaaccccgaaaacccggtaaacgttcggttaacggggccttacgggaccttaaccccgttattccgttaacggttactttcccgtaacgttcccctttaccccggtaacccgttaactttaacccgg

SEQ ID NO: 327937 - DNA, 570 bp, Homo sapiens
  misc_feature: GZ8MTXP01EPL2F.8.88.H11.1.454.CMB.2.raw
  modified_base (208)..(208): a, c, t, g, unknown or other
  misc_feature (208)..(208): n is a, c, g, or t
  modified_base (356)..(356): a, c, t, g, unknown or other
  misc_feature (356)..(356): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgctccgtgggggganagccaccctctcctgcagggccagtgaaccttttagtagtagttatttagcctggtatcggacaaaactggccaggctcccgactctcttcttggtgagcctacgagggccactggccaccccagacaggatcagtggcaggcggtcngggacagacttcaattctcaccatcaacagactgcagctagagatatgacttagtttactatgtacagctaagttagttcgtttaccgtccccggtggtaccggttcggaccgtaagggaaccgaagggtcggaactaacgtaccgaaacgtaacgttggcggttactcgacaaccgttcttctnttcttcncttcccgttcctcttaacgtcg

SEQ ID NO: 327938 - DNA, 615 bp, Homo sapiens
  misc_feature: GZ8MTXP01C6SYR.8.88.H11.1.454.CMB.2.raw
  modified_base (209)..(209): a, c, t, g, unknown or other
  misc_feature (209)..(209): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagagttagttattagcctggtatcggacaaaacctggccaggcctccccgactcctcttcgtttggnggancctacgagggccatcggccaccccagacaggancgagtggcagcgggtcngggacagacttcaattctcaccatacaaacngactgcagcctagaagattattgactagtttactactgtcaggtactagttagttcggttaccgtccccggtaggtaccgttcggacgaacggggaaccgtaaggtcggacaaacgtcccgaaaccggtaacttagggttcggcgttacgccgttaacgttacttccgttaacgttacctttcgtaaccgttcccttaccccgtccgttaacttcccgg

SEQ ID NO: 327939 - DNA, 672 bp, Homo sapiens
  misc_feature: GZ8MTXP01BIKF0.8.88.H11.1.454.CMB.2.raw
  modified_base (210)..(210): a, c, t, g, unknown or other
  misc_feature (210)..(210): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagtagttattagcctggtatcggacaaaactggccaggcctccccgactcctcttcgtttggtggacgccctacgacggggcccacgtcggccaccccgagacaggatcgaggtggcaggcggtccgtggggacaggtacttcaattcctcaccatacaacagactgacacgctagaagtatattgacttagtttactacgtgtacagtactaggttacgttacggtttacccggtccccggttaggggtacccggttccgggacccggtaaagggggaacccgtaaggggtccggtaacgtaaaccgtaccggaaaacccgtacggttcgggttcggaccgttacggaccttaacccgttagttcccgttaacggttcccttcgtaacccttcccgtttaccccgaaccttaacgttcccggg

SEQ ID NO: 327940 - DNA, 668 bp, Homo sapiens
  misc_feature: GZ8MTXP01CH7BG.8.88.H11.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (625)..(625): a, c, t, g, unknown or other
  misc_feature (625)..(625): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccggtgggggganacgccaccctctcctgcgagggccagtactaactttagtagtagttattagctggtatcggacaaaactggccaggcctcccgactcctcttcgttggnggacncctacgacgggcctacgtcggacccaccccgagaccaggactacgagtcggcgaggtcgggtcgtggggacagtaccttcaacttcctcaccactaacaaacacgactcgacacgtccgtaggaatatagtttagactttaacgtttacctacgttcggactaacgactaaagttacgttacggtttaccccggtcccgggttagggtaacccgtttaccggggaacccgtaaacggggaacccgtaaagggtccggaactaaaccgttacggaaaccggtaacgttggtacggctacggccttaacgttnttcgttcgttctctacttccgttcccgaaccgttaacgaaccg

SEQ ID NO: 327941 - DNA, 571 bp, Homo sapiens
  misc_feature: GZ8MTXP01CIRNM.8.88.H11.1.454.CMB.2.raw
  modified_base (210)..(210): a, c, t, g, unknown or other
  misc_feature (210)..(210): n is a, c, g, or t
  modified_base (445)..(445): a, c, t, g, unknown or other
  misc_feature (445)..(445): n is a, c, g, or t
  modified_base (535)..(535): a, c, t, g, unknown or other
  misc_feature (535)..(535): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggcctcccagagacgaccggagagattgtattgacgcagtctccaaccaccctgtctttgtctccgtgggggganacgcccaccctctcctgcagggccagtgtaaccttttagtagtagttatttagcctggtatcggacaaaacctggccaggcctccccgactcctcttctttggtggagcctacgaggggcccacgtcggccaccccagacaggatcgagtggcaggcggtcgtgggacagacttcaattctcacatacaacagactgacagcctagaagtatattgactagttactacttgcagntagttagtcgttaccgtccccgtaggtaccgttcggaccgtaagggaccaaggtggacaagtccgaaccgtattggtcggctcgcaccgnttctcgttctctattcccttccgtccttgttaaccg

SEQ ID NO: 327942 - DNA, 596 bp, Homo sapiens
  misc_feature: GZ8MTXP01AMJXE.8.88.H11.1.454.CMB.2.raw
  modified_base (211)..(211): a, c, t, g, unknown or other
  misc_feature (211)..(211): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (538)..(538): a, c, t, g, unknown or other
  misc_feature (538)..(538): n is a, c, g, or t
  modified_base (553)..(553): a, c, t, g, unknown or other
  misc_feature (553)..(553): n is a, c, g, or t
  modified_base (561)..(561): a, c, t, g, unknown or other
  misc_feature (561)..(561): n is a, c, g, or t
  modified_base (576)..(576): a, c, t, g, unknown or other
  misc_feature (576)..(576): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggganacgccaccctctcctgcagggccagtgtaaccttttagtagtagttattagcctggtactcggacaaaacctggccacggcctccccgacttcctcttcgtttggnggcncctacgcggggccacgtcggcaccccagacaggatcgagtcggcgacggcggggtccgtggggactacgtaccttcaacttcctcaccactaccaacgaggtactcgcacggcctaaggaaatagttattacgacttaacgtttacctacgtgtacagactacgtagttcgttaccggtccgtggtaccgttcggaccgagggacctaggtgactancgaacgacgttgcgngtcgcacncttcgtgtcttaacnctcccgttcctcttaactcg

SEQ ID NO: 327943 - DNA, 672 bp, Homo sapiens
  misc_feature: GZ8MTXP01BENA9.8.88.H11.1.454.CMB.2.raw
  modified_base (209)..(209): a, c, t, g, unknown or other
  misc_feature (209)..(209): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (621)..(621): a, c, t, g, unknown or other
  misc_feature (621)..(621): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctccaaccaccctgtctttgctccgtgggggganagcccaccctctcctgcgagggccagtcgtaacctttttagagttagttattagcctggtancggacaaaactgcagctcccgatctcttnttggngagcctacgnggccncgtcggccaccccgagacaggatcgagtggcaggcggtctggggacagtacttcaaacttctcaccctaataccaaacagtactgaccagtcctaggaaacgtagtttaagttcgaacctttaaggttttaacctacgttacggttacaacggtagtaaggtttaacgttcgggtttaaccccgggttccccggggtagggtaacccggtttcggaaaccgtaaacggggaacccgtaaaggggttacggaccaaacgtaccgaaaccgtaacgttggtacggccctaggcccaaccgttnttcccgtaattccgttaacctacttcccttacccgtaaccttaacgttccg

SEQ ID NO: 327944 - DNA, 550 bp, Homo sapiens
  misc_feature: GZ8MTXP02HEYK6.8.88.H11.1.454.CMB.2.raw
  modified_base (206)..(206): a, c, t, g, unknown or other
  misc_feature (206)..(206): n is a, c, g, or t
  modified_base (380)..(380): a, c, t, g, unknown or other
  misc_feature (380)..(380): n is a, c, g, or t
tcagctcgcgtgtccacgaccggtgctcgatttagcgacagcgagaacacacaaagggggagaagagctgctcagttaggacccagagggaaccatggaaagcccagcgcagcttctcttcctcctgctactctggctcccagagacgaccggagagattgtattgacgcagtctccaaccaccctgtctttgtctcctggggganagccaccctctcctgcagggccagtgaaccttttagagtagttatttagcctggtatcggcaaaacctggccaggctccccgactcctcttcttggtgagcctacagggccactggcaccccagacaggatcagtgcagcggtctgggacagacttcattctcaccatcaaacngactgcagcctagaagatattgctagtttactactgtacagcagtatcgttacgtccccgtaggtaccgttcggacctaaggggaccctaagggtcggactaaagtccgaaaaccgaactggtcggactcggaccaccattctgttcttcacttccttcccgctacttcg

SEQ ID NO: 327945 - DNA, 598 bp, Homo sapiens
  misc_feature: GZ8MTXP02GNYHO.8.88.H11.1.454.CMB.2.raw
  modified_base (209)..(209): a, c, t, g, unknown or other
  misc_feature (209)..(209): n is a, c, g, or t
  modified_base (385)..(385): a, c, t, g, unknown or other
  misc_feature (385)..(385): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcgagggccaggtcgtaacctttttagtagtagtttatttagcctggtatcggacaaaacctggccaggctccccgactcctcttcttggtggagcctacgagggccactggccaccccagacaggatcagtggcaggcgggtctgggacagacttcattcncaccatcaacagactgcagcctagaagatattgactagtttactactcgtacagctagtattcggtttaccgtccccggtagggtacgttccggaccgaaacggggtaccaaagggtcggacaaagtaccgaaaaccgtaacgtggtacggctacggacctaccagttcgtaacgttccttacgtacttccgttaccccggtcctaacttccg

SEQ ID NO: 327946 - DNA, 516 bp, Homo sapiens
  misc_feature: GZ8MTXP02HS6XP.8.88.H11.1.454.CMB.2.raw
  modified_base (207)..(207): a, c, t, g, unknown or other
  misc_feature (207)..(207): n is a, c, g, or t
  modified_base (511)..(511): a, c, t, g, unknown or other
  misc_feature (511)..(511): n is a, c, g, or t
tcagctcgcgtgtccacgaccggtgctcgatttagcgacagcgagaacacacaaagggggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagagtagttatttagcctggtatcggcaaaaactggccaggctccccgactcctcttctttggtggagcctacagggccactggcaccccagacaggatcagtggcagcggtcctgggacagacttcattctcaccatcaaacagactgcagcctgaagatattgcagtttacactgtcagcagtatgttacgtcccgtggacgttcggaccaaggggaccaaggtggacaatcaaccgaatgtcgctgcacatctgtctctactctccncactc

SEQ ID NO: 327947 - DNA, 612 bp, Homo sapiens
  misc_feature: GZ8MTXP02F8D49.8.88.H11.1.454.CMB.2.raw
  modified_base (208)..(208): a, c, t, g, unknown or other
  misc_feature (208)..(208): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganacgccaccctctcctgcagggccagtgtaaccttttagagtagttattagcctggtatcggacaaaactggccaggctccccgactcctcttcttggtgagcctacagggccactggccaccccagacaggatcgagtggcaggcgggtctggggacagacttcattcncacatcaacngactgcagcctagaagntatgactagtttacactgtacagtacagttatcgttaccgtccccgtagggtacgttcggaccgaagggacccaaagggtcggactaaacgtaccgaaacccgtaacgttggtacgggtactacgggaccctaaaccggtactttacccgttaaggttcccctttacgtaaccgtttcccctttaccccggacccttactttaaccgg

SEQ ID NO: 327948 - DNA, 610 bp, Homo sapiens
  misc_feature: GZ8MTXP02F6LLR.8.88.H11.1.454.CMB.2.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcagggccagtgaaccttttagagtagttattagcctggtatcggacaaaacctggccaggctccccgactcctcttcttggngagcctacagggccactggccaccccagacaggatcagtgcagcggtctgggacagacttcattctcaccatcaanagactgcagcctagaagatatgactagtttactactgtacagctagtattcgttaccgtccccgtaggtacgttccggaccgtaacggggaccgtaagggtcggactaaaacgtccgaaaaccggtaacgtcggtacggggtaccttacggacccgtaacccgtacttaccgttcggtttccctttaccgtacctttaccccggtttcccccgacctaactttacccgg

SEQ ID NO: 327949 - DNA, 564 bp, Homo sapiens
  misc_feature: GZ8MTXP02IFIHO.8.88.H11.1.454.CMB.2.raw
  modified_base (208)..(208): a, c, t, g, unknown or other
  misc_feature (208)..(208): n is a, c, g, or t
  modified_base (394)..(394): a, c, t, g, unknown or other
  misc_feature (394)..(394): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggacaaaacctggccaggctccccgactcctcttctttggtggagcctacgagggcccactggccaccccagacaggatcagtgcagcgggtctggggacagacttcattctccaccatcaaaccanactgcacgccctgaaagattattgactagtttactactgtcagtcagtatgttacgcccgtggaccgttcgacgaagggaccgtaaggtcggacaacgtacaacccgtaacgtggacggtctacgccacctacgtcctcgttctacacttcccgtcccgtacctattccg

SEQ ID NO: 327950 - DNA, 581 bp, Homo sapiens
  misc_feature: GZ8MTXP02GN1WF.8.88.H11.1.454.CMB.2.raw
  modified_base (209)..(209): a, c, t, g, unknown or other
  misc_feature (209)..(209): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagtagtagttatttagcctggtatcggacaaaacctggccaggctccccgactcctcttcttggtggagcctacaggggcccacgtggccaccccagacaggatcagtggcaggcggtcctgggacagacttcattctcaccatcaacagactgcagcctagaagatatgactagttactactgtcagctagtatgttaccgcccgtggtacgttcggacgaagggaccaagggtcggactaaacgtaccgaaaaccggtaacgtggtacggcgttacgacctaccgaacttccgtcggttccttacctacttcccttacccccgtcctaacttcccg

SEQ ID NO: 327951 - DNA, 631 bp, Homo sapiens
  misc_feature: GZ8MTXP02IY43S.8.88.H11.1.454.CMB.2.raw
  modified_base (210)..(210): a, c, t, g, unknown or other
  misc_feature (210)..(210): n is a, c, g, or t
  modified_base (408)..(408): a, c, t, g, unknown or other
  misc_feature (408)..(408): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagttagttatttagcctggtatcggacaaaactggccaggcctcccgactcctcttcttggtggacgcctacgacggggccacgtcggacccaacccccgagaaccgaggatcgaggtcggcaggccggggtcctggggacaggtactttcgactttccncacctaataccaaacagactgacacgcctagaagtatagttgactacgtttactacgtgtacagctagttattcggttaccgtccccggtaggtaccggttccggaccgaacggggacctaaaggggtcgacgaataccgaaacgtacgtcggtacggactcggtacctaacgtacttcgttaacgttccttactacttccgtttaccccgacttacttaccg

SEQ ID NO: 327952 - DNA, 598 bp, Homo sapiens
  misc_feature: GZ8MTXP02ISIYH.8.88.H11.1.454.CMB.2.raw
  modified_base (209)..(209): a, c, t, g, unknown or other
  misc_feature (209)..(209): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (588)..(588): a, c, t, g, unknown or other
  misc_feature (588)..(588): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcgagggccagtgtaacctttttagagtagttatttagccttggtatcggacaaaaacctggccaggcctccccgactcctcttcttggngancctanagggccatggccaccccagacaggatcagtggcaggcggtctggggacaggacttcattcncaccatcaaacgagactgcacgtcctagaagattattcgactaaggtttactagtgtacatacagttatacggtttaccgtccccggtagggtaccgttcggaccgtaaacgggacccgaagggtacgaaccgaaataccgaaaacgtaccgttggtacggctacggaccaacctatcctaagttctactacttcccgttccccnctaacttccg

SEQ ID NO: 327953 - DNA, 646 bp, Homo sapiens
  misc_feature: GZ8MTXP02IOAY4.8.88.H11.1.454.CMB.2.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
tcagctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtcgtaaccttttagagttagttattagccttggtatcggacaaaacctggccaggcctccccgacttcctcttcgtttggngacgcctacgcgggccacgtcggccacccagacagggatcgagtgcacggtcggtccgtaggggacaggtacttctaacttctccacctataccaaacagtactcgacacgtcctagaaacgtattaacttgacgttaagtttacctacgttacggtacagtacctaagtttacgttacggtttaacccgggttccccggttaggggtaccgttccggaaccggaacggggtaccgaagggtccgaactaaacgacccgaaacggtacgtggtacgcgtacgaccaccgtatccgtgttacttacaccgttccttacccgacttactaccg

SEQ ID NO: 327954 - DNA, 570 bp, Homo sapiens
  misc_feature: GZ8MTXP02ILJV9.8.88.H11.1.454.CMB.2.raw
  modified_base (210)..(210): a, c, t, g, unknown or other
  misc_feature (210)..(210): n is a, c, g, or t
  modified_base (535)..(535): a, c, t, g, unknown or other
  misc_feature (535)..(535): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagagttagttatttagcctggtatcggacaaaaccgtgccaggcctccccgactcctcttcgttggtggagcctacaggggcccactggccaccccagacaggatcagtcgcaggcgggtcctggggacagtacttcattcctcaccatcaaacacgactgacacgcctagaagatatgctagtttactactgcagctagtattcgttaccgtcccgtacggacgttaccggaccgtaagggaccgaaggtgactaagccaaacggacctggcggctacggaccaacctntctaacgttcctacgacttccgtcccctctactcg

SEQ ID NO: 327955 - DNA, 691 bp, Homo sapiens
  misc_feature: GZ8MTXP02HL7SA.8.88.H11.1.454.CMB.2.raw
  modified_base (212)..(212): a, c, t, g, unknown or other
  misc_feature (212)..(212): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctcccaaccacccttgtctttgtctccgtgggggganacgcccaccctctcctgcgagggccagtacgtaacttttagagttagttattagcctggtactcggaacaaaaccgtggaccacggcctccccgactcctctttcgttggtcggacgtcctacgacgggcccacgtcggacccaccccgagaccgagggactcgaggtcggacgacgggtacggggtccgtacggggaactacggtacttactactttccacctaccataccaaccagactgacacgctaagaactatattagactttacgtttactacgttagtacacgtactacgttagtttaccggttaacccgttcccggttacggggttaccgttaccgggaaccggtaaacgggtaaccggtaagggacggtaacgaacgtaaccggaaaccgtacgtcgggttacggcttacggacctaacctcttaccgtcgtttacctacttaccttcccggttaccaccgttactaccg

SEQ ID NO: 327956 - DNA, 646 bp, Homo sapiens
  misc_feature: GZ8MTXP02H0T45.8.88.H11.1.454.CMB.2.raw
  modified_base (211)..(211): a, c, t, g, unknown or other
  misc_feature (211)..(211): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
tcagctcgcgtgtccacgaccggtgctcgatttagcgacagcgagaacacacaaagggggggagaagagctgctcagttaggacccagagggaaccatggaaagcccagcgcagcttctcttcctcctgctactctggctcccagagacgaccggagagattgtattgacgcagtctacccaaccaccctgtctttgtctccgtggggganagcccaccctctcctgcagggcctagtacgtaaccttttagtagttagttatttagccgtaggtatcggacaaaaaccgtggaccacggcctccccgactcctctttcgttggtggcgcctacgacgggcacgtcgaccaccccgagacgagntcgagtgcgaggcggtccgaggacagtacttcacttcncaccataccaacagactgacacgctagagtatattgtacttaacgtttactacgtacgtcgagaccgttagtttacgttaccggtttaacccgtcccggttagggtacccggttacggacccggaaacgggtacccgtaaaggtcgaacgtaaacgtaacccgtaaacgtaacggtcgtcggtacacggtacccaactcgtcttcgttaccttactaccgttccctttacccgcgttaactccg

SEQ ID NO: 327957 - DNA, 645 bp, Homo sapiens
  misc_feature: GZ8MTXP02H8T0A.8.88.H11.1.454.CMB.2.raw
  modified_base (210)..(210): a, c, t, g, unknown or other
  misc_feature (210)..(210): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
tcagctcgcgtgtccacgaccggtgctcgatttagcgacagcgagaacacacaaaaggggggagaagagctgctcagttaggacccagagggaaccatgtaaagcccagcgcagcttctcttcctcctgctactctggctcccagagacgaccggagatattgtattgacgcagtctccaaccaccctgtctttgtctccgtgggggganacgccaccctctcctgcacgggccagttgtaaccttttagtagttagttatttacgcctggtatcggacaaaacctggccaggcctccccgactccctctttcgtttggtggacgcctacgcggggtcccacgtcggcccaccccgagacagggactcagtggcgaggcgggtccgtgggacagtacttctattcncaccgtatacaacagactnacacgctagaagtatacttgactagtttactactgtacagctagtactcggttaccgtcccggtgggtaccgttcggtaccgaagggaccgtaaagggttcgactaaacgtaccctaaaaccggtacgtgggtcgtaccgtacggaccctaaaccgtattcccgtttcgttacctttccgtaacgttttcccctaccccggtttccctaagtttccccgg

SEQ ID NO: 327958 - DNA, 573 bp, Homo sapiens
  misc_feature: GZ8MTXP01ED0QJ.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataaagacactgagacggccctcgagggactcccgtgagcgattcctctggctcgaggtcagggaacaacggtcacattcggccatcgagtggagtccgaggcagaggacgagctgactattattgtacaaatcaaacagaaccacctagtttacggtaactttagtgttacgttacggaacttcggccgaaccgtaagggttccaacccggttccgttcggggttccaacgggccccaaacgggccccaaaacccccgtcgttaccgtaaccttaaccgttccg

SEQ ID NO: 327959 - DNA, 505 bp, Homo sapiens
  misc_feature: GZ8MTXP01AM2FY.52.42.D09.1.454.CMB.2.raw
  modified_base (495)..(495): a, c, t, g, unknown or other
  misc_feature (495)..(495): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagcgggccaggcccctgtgtggtgatgtataaagacactgagaggccctcagggatccctgagcgattcctctggctccaggtcagggcaacggtcacattggcatcagtggagtccaggcagaggacgaggctggactattatgtacaattcaacagacaccattggtacttatgtcttcgggaactgcgacaaaggttcgaaccgtcttgggcacgcccaaggcccaacccancgtcaactcc

SEQ ID NO: 327960 - DNA, 502 bp, Homo sapiens
  misc_feature: GZ8MTXP01DZCXH.52.42.D09.1.454.CMB.2.raw
  modified_base (236)..(236): a, c, t, g, unknown or other
  misc_feature (236)..(236): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
tcagcgcagtacgacacgaccggtgctcgatttagacacatacgcagggaaggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaaccgntatgcttatggtaccagcagaagcggcaggcccctgtgtggtgatgtataaagacactgagaggcccctcgagggatccctgagcgattcctctggctccaggtcagggcaacggtcacattggccatcagtgagtcagcagaggcgaggctgactattattgtacaatcaaacagacaccattggtaactttatgtcttcggaactgcgaccaaggttcaccgtcttgggttcacgcccaaaggcccaaccccncttcgtcnctc

SEQ ID NO: 327961 - DNA, 548 bp, Homo sapiens
  misc_feature: GZ8MTXP01B6G6O.52.42.D09.1.454.CMB.2.raw
  modified_base (284)..(284): a, c, t, g, unknown or other
  misc_feature (284)..(284): n is a, c, g, or t
  modified_base (411)..(411): a, c, t, g, unknown or other
  misc_feature (411)..(411): n is a, c, g, or t
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgttggtnatagtataaagacactggagacggcccctcgaggggactccccgtgagcgtatttcctcgtggctccgaggtcaagggaacaaacggtcacattggccatcagtgagtcaggcagaggtacgaggcngaactattaagttgtacaaattcaaacagacaacctagttggttaacttatgttcttacggaacttggacgttacgaaacggttcaaccgtccgttgggttcacgccccaaggcccaaccccattcgtcaacttccg

SEQ ID NO: 327962 - DNA, 590 bp, Homo sapiens
  misc_feature: GZ8MTXP01AMI8C.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaaggacagacggccaggatcacctgctctggagatgcattcgaccaaacgatatgtcttattggtacagcagagcggcaggccctgtgtggtgatgtataaagacacgtgagacggccctgagggactccctgagcgattcctctggctcgaggtacagggaacaacgggtcacattcgcatcagtgagtcaggcaggaggacgaggctagacttattattgtacgaaattacaaacgacaacaccctagtttaggtacctttagtcgttaccgttacgggaaacttcggacccgttaaaccgtacggttcccgtaaacccggttccgttacgggggttccaaccggtaaccccgaacgggccccaaaccccgcgttaacgtccgttaaccgtttccccg

SEQ ID NO: 327963 - DNA, 575 bp, Homo sapiens
  misc_feature: GZ8MTXP01CM123.52.42.D09.1.454.CMB.2.raw
  modified_base (463)..(463): a, c, t, g, unknown or other
  misc_feature (463)..(463): n is a, c, g, or t
  modified_base (567)..(567): a, c, t, g, unknown or other
  misc_feature (567)..(567): n is a, c, g, or t
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctctggagatgcattcgaccaaaaccgatatgtcttattggtacagcagaacgccgggccacggcccctgtgttggtgatgtaataaagacactgagacggccctcgagggactcccgtgagcgtatttccctcgtcggctccgagggttaccgaagggaacaacgggtaccacgtaagttcggacctatccgaggtggacgtccgaggcaggaggacgaggctgacttattattgtacaatacaaanacgacacctagttacgttacttatcgttacttacggacttggacacgtaaacggttccaccgtcgttcgggttcacgcccaacggcccaacccgacttcgtccnctttcccg

SEQ ID NO: 327964 - DNA, 746 bp, Homo sapiens
  misc_feature: GZ8MTXP01BPHFQ.52.42.D09.1.454.CMB.2.raw
  modified_base (221)..(221): a, c, t, g, unknown or other
  misc_feature (221)..(221): n is a, c, g, or t
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgctattcgaccaaaccgatatgtcttattggtaccagcagaagccggcacggccctgtgttggtgatgtaataaagacactagagacggccctagagggactcccgtgacgcgtacttcctcgtggccttcccgaggttaccgaacggggaaccaaacgggttccaacgtaagtttcggggaccctagttaccgaaggttcgggtaactttcccggaagggaccgaagggaaacgggtaccggaaagggtccgttaggtaaacctttaagtttaagtttacgtaacgtaaagtttaccaaaaccgtacggaaccaacccttaagtttacgggttaaaccctttaagttccggttaccgttttaccgggaaaaccgtttcggaaacccggttaaacccggtaaaacgggttcccgtaaacccggtttcccggttacgggggttacccaaccgggaacccccgtaaaaccgggcccccttaaaacccccgaaccgttccggtaaccccgttaacccgtttccccg

SEQ ID NO: 327965 - DNA, 577 bp, Homo sapiens
  misc_feature: GZ8MTXP01APXAO.52.42.D09.1.454.CMB.2.raw
  modified_base (289)..(289): a, c, t, g, unknown or other
  misc_feature (289)..(289): n is a, c, g, or t
  modified_base (472)..(472): a, c, t, g, unknown or other
  misc_feature (472)..(472): n is a, c, g, or t
  modified_base (561)..(561): a, c, t, g, unknown or other
  misc_feature (561)..(561): n is a, c, g, or t
  modified_base (569)..(569): a, c, t, g, unknown or other
  misc_feature (569)..(569): n is a, c, g, or t
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggactcacctgctctggagatgcattcgaccaaacgatatgtcttattggtaccagcagaagccggcaggtccctgtggttggtnatgtaataaagcactgagacggcccctagagggtactccccgtggacgcgtactttcctcgtcggcctccgagggtacgaacggggaacctaaacgggtcaaacgtacgttcgggaccctagtcgaggttggacgtccgagggcaaggacggacgaggctagacttattattgacaatacaanagacacgtattggtacttatcgtcttacggaattcgacgaccgtaaggttccaaccgtcgttagggcacgaacccgacggcccaacccngttctccncgttcccg

SEQ ID NO: 327966 - DNA, 592 bp, Homo sapiens
  misc_feature: GZ8MTXP01B50RZ.52.42.D09.1.454.CMB.2.raw
  modified_base (420)..(420): a, c, t, g, unknown or other
  misc_feature (420)..(420): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccggcacggccctgtgttggtgatgtataaagacactagagacggccctgagggactccctgagcgtattcctcgtggctccgaggtcagggcacgggtcacattggccatcagtggagtccgaggcaggaggacgaggctgactattattcgtanaatacaaacagacctaacctagttaggtacttatcgttcttaccggaacttgaccgaaccgtaaacgggttcctaaacccggttccgttacggggttccgaaaccggaacccccgaaaccggggaaccccctaaacccccaccgtttccggtcccgttaaaccgtttccccg

SEQ ID NO: 327967 - DNA, 641 bp, Homo sapiens
  misc_feature: GZ8MTXP01A7G6W.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcactgctctggagatgcattcgaccaaaccgatatgtcttattggtaccagcagaagccggccacggcccctgtggttggtgatgtaataaagacacgtagaagacggccctcgaagggactcccgtagacgcgtactttccgtcgtggcctccgaggtacgaacgggaacgaaacgggtcaacgtacgttcgggacccagttacgagttcggacgtccgaggacgaaggaacgggacgaggacgtagaacttaattagttacgtacgtaaacttacaaacacgtaacctaaccgtagtttacggttaactttagttcgtacgttacggaacttcgacgttaccgtaaacggttccgaccggttccgttacggggttccacggaaccccgaacggaaccccaaacccctcgttaccgtccgaaccgtttcccg

SEQ ID NO: 327968 - DNA, 726 bp, Homo sapiens
  misc_feature: GZ8MTXP01AR9XS.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctctggagatgcattgaccaaaccgatatgtcttattggtaccagcagaacgccgggccacggccctggtgttggtgattgtaataaagacacgtgaagacggccctgaggggtactcccgtagacgtcgtatttcccgtcgtgggcctcccgaggtacgacggggaactaaaccgggtcaacgtagttcgggaccaagttccgaaggttcgggacggtacccgaggggaccgaaggaacggggacggaacgggcctaggtaaacctttaatttagtttaggtaaccgtaaattacccaaacgaacggaacctaaccctaagtttacgggtttaaccttttaagtcgttaccgtttaaccgggtaaacgttcggaccggttaaacccgtaaacgggttcccgtaaaccccggttcccggtttcgggggttacccaacccgggaaccccgaaaaccgggtaacccccaaaaacccccgtcgtttccgggtccccgttaacccttttccccgg

SEQ ID NO: 327969 - DNA, 590 bp, Homo sapiens
  misc_feature: GZ8MTXP01CAHCZ.52.42.D09.1.454.CMB.2.raw
  modified_base (239)..(239): a, c, t, g, unknown or other
  misc_feature (239)..(239): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtacagcagaagccggcacggccctgtgttggtgatagtaaataaagacacgtagagacggcccctacgagggactcccgtagacgcgtattcccgtctggcctccgaggtacacggggaacaaacggtcactagtcggaccagtcagtggactccgaggcagagggtacgaggctagactattagtcgttacgaaatcaaacagacaacctatttacggtaactttagtcgttcttaacggaatcggaaccgacgtaaaggttccaaccggtcttcggggttcaacggccccgaaaacggccccaaaaccccggtacttcggtaaccttcccgtttcccg

SEQ ID NO: 327970 - DNA, 499 bp, Homo sapiens
  misc_feature: GZ8MTXP01D3Y4P.52.42.D09.1.454.CMB.2.raw
  modified_base (238)..(238): a, c, t, g, unknown or other
  misc_feature (238)..(238): n is a, c, g, or t
  modified_base (409)..(409): a, c, t, g, unknown or other
  misc_feature (409)..(409): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaacgntatgcttatggtacagcagaagccggcaggcccctgtgtggtgatgtataaagacactgagaggcctcgagggatccctgagcgattcctctggctccaggtcagggcaacgggtcacattggccatcagtgatcagcagagacgaggctgactattatgtacaatcaaanagacaccattggtacttagtgtcttcggaactgcgacaaggttcaccgtcagggttcacgcccaaggcccaacccattctcaacgttccg

SEQ ID NO: 327971 - DNA, 784 bp, Homo sapiens
  misc_feature: GZ8MTXP01E14IA.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggccaggcccctgtgttggtgatagtaataaagacactgaagacggccctacgaagggactcccgtgaggcgtattccgtcgtggcctaccgaaggtacgaacggggaacaaaccgggttcaaacgtaaccgtttgggaccccaaagttcccgtaagggtttaggggaacgtttccccggaaggggaccgaaggggaaaccgggggaacgggttaaaggggcccttaaacgggaacgttttaaagttttaaagtttaccgtttaaccgaaaacgtttaaaccgaaaaccgtaaaacgtaaacccgaaaccccgttaaattttaggggtttaaacccttttaaacgttggtttacccgttttaaccggggaaaactttcgggaaccgttaaacccccggaaaaggggtttcccaaacccgggttccccgttagggggttaccaaaccggaacccccgtaaaaccggggaacccccaaaaccccccgaccgtttacgaaccccgttaaccgtttaacccccg

SEQ ID NO: 327972 - DNA, 545 bp, Homo sapiens
  misc_feature: GZ8MTXP01C1OL9.52.42.D09.1.454.CMB.2.raw
  modified_base (237)..(237): a, c, t, g, unknown or other
  misc_feature (237)..(237): n is a, c, g, or t
  modified_base (434)..(434): a, c, t, g, unknown or other
  misc_feature (434)..(434): n is a, c, g, or t
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggccaggccctgtgtggtgatgtataaagacactgagacggccctcgagggactcccgtgagcgattcctcgtggctccgaggtcaagggaacaaacgggtcacagttcggacccatccgagttggagtccgaggcaggaggacgaggctagactattattgtacaatcaanagacacctattggtaacttatgtcttcggaactgacgacgtaaggttccgtaacccgtcgttcgggttcacggcccaacggccccaaccccacgttctcccaacgttcccg

SEQ ID NO: 327973 - DNA, 673 bp, Homo sapiens
  misc_feature: GZ8MTXP01B6FLN.52.42.D09.1.454.CMB.2.raw
  modified_base (243)..(243): a, c, t, g, unknown or other
  misc_feature (243)..(243): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctcgtggagatgctattcgacccaaaacgntatgtacttattggtacagcagaacgccgggccacggccctggtcgttggtagtagtagtaagtaaagacacgtaggaagtacggttcctacgacgggtacttccccgtaggacgtcggtactttcccgtcgtcggtcctaccgtacgggttaaccgaacgggtaaccgtaaacgggtccaaacgtacgttcgggacctaagttccgaggttcgggacgtaccgagggcgaaggaggaacggacggtctaggtacttaattagtttacgtaactaaacgttacgaacgtaacgaacctaaccgtatttacggttaaccttattcggttacttaccggtaataacggacgttaaccgtaacgttccgtaaccgttcgttacgggttcaccgaacccgaacgcccaacccgtattcgtccttaacgttcccg

SEQ ID NO: 327974 - DNA, 551 bp, Homo sapiens
  misc_feature: GZ8MTXP01DKT2N.52.42.D09.1.454.CMB.2.raw
  modified_base (428)..(428): a, c, t, g, unknown or other
  misc_feature (428)..(428): n is a, c, g, or t
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcagggactccctgagcgattcctctggctccgaggtcgaagggaacaacgggtcaacattggccatcagtggagtccgaggcagaggacgaggctagactattatgtacaatcaaanacgacaacctattaggtacttagtgttaccgttcggaactgacgacaaacgggttccaacccggtcgttcggggttcacggaaccccgaaaggccccaaccccacttcggtccaacgttcccg

SEQ ID NO: 327975 - DNA, 532 bp, Homo sapiens
  misc_feature: GZ8MTXP01DVBBF.52.42.D09.1.454.CMB.2.raw
  modified_base (427)..(427): a, c, t, g, unknown or other
  misc_feature (427)..(427): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaagccggccaggcccctgtgttggtgatgtataaagacactgagaggccctcagggactcccgtgagcgtattcctcgtggcctccgaggtcaagggcaacgggtcacagttggaccatcagtggacgtccgaggcaggaggacgaggctagactattattcgtanaatcaaacagtaccacctagttaggtaactttatgtcttcgaatgcgacctaagttcgaccgtcttgggttcacgcccgaagccctaaccccncttctcncgtcg

SEQ ID NO: 327976 - DNA, 624 bp, Homo sapiens
  misc_feature: GZ8MTXP01A9SZX.52.42.D09.1.454.CMB.2.raw
  modified_base (284)..(284): a, c, t, g, unknown or other
  misc_feature (284)..(284): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcacggccctgtgttggngatgtataaagcactgagacggccctacgagggactcccgtagagcgtatttcccctcgtggctccgaggtacacgggaacaacgggtcacgtagttcggacctagtcgaggtggacgtccgaggcaggaggacgaggctagacttattattgactaaattcaaacagaacctaccgtagtttaggttaacctttagtcgttcgttacggtaaacgttcggaccgttaaccgtaacggttaccgtaacccggttccggttacggggttcccaaccggaaccccgtaaaccgggtaaccccaaaccccgtacgttccggtaaccgttaaccctttccccgg

SEQ ID NO: 327977 - DNA, 722 bp, Homo sapiens
  misc_feature: GZ8MTXP01DNJDR.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacaggacggccaggatcacctgctcgtggagatgactattcgacccaaaaccgtatatgtactttaagttcggtaaccagcgaaggaaacggcccggggacccacgggccccgttggtggttggtagtattagtaaataaaggactacgtaggaaggaccggtcccctaggaacggggacttcccgtagacgtcgtacttccctcgtggcctaccgagggtacgaagggaaccgtaaacgggtcacgtagttcggacctatccgaggttggaacgtccgaagggcaagggagggacgaggtactaggacttaagttagttcgtaacgtaaataaccaaacgaacgtaacctaaccttaagttacgggtttaaactttagtggttacccgttaacgggtaactaacggtaacccgaaccggtaaacggttccgtaacccggtcccgttacgggggttaccaacccggtaaccccgaaaccgggtaacccctaaacccccggtattcccgtaaccgttaaccccttcccg

SEQ ID NO: 327978 - DNA, 653 bp, Homo sapiens
  misc_feature: GZ8MTXP01EVSQW.52.42.D09.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgntatgcttatggtacagcagagccggcacggccctgtcgtggtnatagtaataaagacactagaagacggtccctcgaagggtactcccgtgacgtcgaactttcccgtcgtcgggcctaccgtacgggtaacgaacgggaaccgtaaacgggtcaactaagtttcgggaccctataccgtaggtcgggaacgtccggaagccgaaggaacgggacggagggcctagaactattaagttacgtacaaattacaaacacgaaactacctaagtttaggttaaacctttagtacgtttacgtaacgggtaactcgtaaccgaaccgtaaacgggttcctaaccggttcccgttagggaccgaccgaaccccgaaacgggaaccccaaacccgacttccgtaacttcccttaacccg

SEQ ID NO: 327979 - DNA, 651 bp, Homo sapiens
  misc_feature: GZ8MTXP01EF978.52.42.D09.1.454.CMB.2.raw
  modified_base (362)..(362): a, c, t, g, unknown or other
  misc_feature (362)..(362): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgtcttagttcggtaccagacaggaacgccgggtccacggcccctggtgttggtgatgtaataaagacactggagacggcccctagaggggtactccccgtaggacgaccggtatttcccncgttggcctcccgaggtaccgaagggaacgtaacgggtacactagttcgggacctattacgagtggacgtccgaggacgagaacgggacgaggcgtagacttattattgtacaatacaaacgagacctaacccgtagtttacggttaactttagtcgttaccgtttagggaaaccttggacccgaaacggtaacggttcccgtaaaccggttcccgttgggggttacccacggaacccccgaaacgggaacccctaacccccggattccggtcccaacggttttccccg

SEQ ID NO: 327980 - DNA, 687 bp, Homo sapiens
  misc_feature: GZ8MTXP01BZ5TV.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgacttattggtaccagcagaacgccgggccacggcccctggtcgttggtcgatagtaataaagcactggagacggcccctagaggactccccgtgacgcgtattcccgtactggcctccgaggtccgaacgggaacgtaacgggtcaacgtacgttcggacctatcgacggttggacgtacgagggccgaagggaacgggacggagggtcctaggtaccttaagtttacgttacggtaactaacgttacaaacgtacggtaaccctaccttaaggtttacgggttaaccttttagtcggtttaccgttacgggaaacttcgggacccgaaaccggtaacgggttccctaaaccccgggtttcggttaccgggggttccacccggggaaccccgtaaacgggcccctaaaccccgacgtttaccgaacccgttaacctttccccgg

SEQ ID NO: 327981 - DNA, 680 bp, Homo sapiens
  misc_feature: GZ8MTXP01DFR7J.52.42.D09.1.454.CMB.2.raw
  modified_base (242)..(242): a, c, t, g, unknown or other
  misc_feature (242)..(242): n is a, c, g, or t
tcagcgcagtacgacacgaccggtgctcgatttagacacatacgcagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggatcactgctctggagatgcattcgacccaaaccgntatgtacttagttcggtaccagcaaggaacggcccgggcacggtccctggtggttggtagatagtaaataaagactacgtaggaggaccggtccctacggaaggggtacctcccgtagaacgcgtacttccctcgtcggcctcgaggtaccgaacgggaacgaacggtcactagtcggactagtcgagtggacgtccgaggacgaagggaaggacggaggtactagaacttagttacttagactaaacgtcaaacacgtaacctaaccgttagtttacggttaaacctttagtcggtttacgttaaccggaacttaacggaccgttaaaccggtaacggttccgtaacccggttcggttacggggccttaacccgggaaccccgaaaccggaaccccctaaccccgacgttaccggtaacccttaaccgtttccccgg

SEQ ID NO: 327982 - DNA, 737 bp, Homo sapiens
  misc_feature: GZ8MTXP01B41NH.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtacagcagagccggcagccctgtgtgtgatgtataagcactgagacggccctgagggactcccgtgagcgtacttcccgcgtggcctccgaggtacgaacggggaacctaaacgggtcaacgtaacgttcgggaccctagtaccgaggttggacggtaccgaagggaccgaagggaacgggaaccgggtaggccgttaggtaaaccttaagttttaacgtttacgggtaaccgtaaacgttaaccaaaaccgtaacggtaaaccctaaacccgttaaggttttaacgggtttaaacccttttaggttaccggttaccgtttacccgggtaaaccgttcgggtaacccggttaaacccgttaaacggggttcccgtaaaccccggggttccggttaccgggggttacccaacccgggtaaccccgaaaccggggaacccccctaaaaccccgtccgttaccgggttcccgttaaaccctttccccgg

SEQ ID NO: 327983 - DNA, 674 bp, Homo sapiens
  misc_feature: GZ8MTXP01AYB45.52.42.D09.1.454.CMB.2.raw
  modified_base (239)..(239): a, c, t, g, unknown or other
  misc_feature (239)..(239): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgtcttattggtaccagcagaagccggcacggccctgtgtggtgatgtaataaagacacgtgagacggccctagagggactccctgacgcgtactttccctcgtggcctaccgaggttaccgaaggggaaccgaaccgggtacaacgtagtttcgggacctagtcgaaggttcggacggttacccgagggccgaaggggacgggtaacggaggtctacggtaaccgttatttaaacgtttcgtaacgtaaattaaccggaaaccaacggttaaaccaacccgttaagtttacgggttaaacctttaattcgggttaccttacggggtaaacttcggtaacccgaaccgtaacggttacccgtaaccgtcccggttacgggttccaccggaaccccgaacggccccaacccgacttcgtaaccaactttccccg

SEQ ID NO: 327984 - DNA, 719 bp, Homo sapiens
  misc_feature: GZ8MTXP01EM3R3.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggactcacctgctcgtggagatgctattcgaccaaaccgatatgtcttattggtaccagacaggaacgccgggccacggcccctggtgttggtgtagtagtaataaagacacgtgaagacggccctagagggtactcccgtagacgcgtattcccgcgtacggcctcgaggtaacgaacgggaacgaacggtacaacgttcgtacggacctagtacgagggtacggtacgtccggaaggaccgtaagggaaccgggacgggagtccgtagtaaacttagttaagttacgtaaacgtaaactaacaaacgtaacgaacctaaccgtagtttaacggttaactttacgtacggttacccgttaccggtaacgtaaccgggtaacccgttaaaccggtaaaccggttccccgtaaacccgggttcggttaccgggttccgaacccgggtaaccccgaaaccccgggaacccctaaaccccccggtagttccccgtaacccgttaacccgtttcccccg

SEQ ID NO: 327985 - DNA, 673 bp, Homo sapiens
  misc_feature: GZ8MTXP01ANQQD.52.42.D09.1.454.CMB.2.raw
  modified_base (554)..(554): a, c, t, g, unknown or other
  misc_feature (554)..(554): n is a, c, g, or t
tcagcgcagtacgacacgaccggtgctcgatttagacacatacgcagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattgaccaaacgatatgtcttagtggtaccagcaagaacggccggccacggccctggtgttggtgatgtaataaagacagtgagacggccctagagggtactcccgtgagcgtaactttcccgtacgtcgggccctacggtacggtaaccggaacgggaaccgtaaccgggtactaacgtacggttaccggacctaagtcgaacggtggacgtaccggagggacgaagggaacgggaggtacggtacgtaagtaacgtttattagttacgtaacgtaaactaacgaaactaacgaaacctaccgttaagtttacgttaaccgtttnttacggttaccgtaacggtaacgtaacggaaccgttaaacgtaaccggttccgtaacccggtcggttacggcaccgaacccgaacgaacccacccgtcttcgtaaccgttaacttcccg

SEQ ID NO: 327986 - DNA, 689 bp, Homo sapiens
  misc_feature: GZ8MTXP01BMVII.52.42.D09.1.454.CMB.2.raw
  modified_base (240)..(240): a, c, t, g, unknown or other
  misc_feature (240)..(240): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattgaccaaacgntatgcttatggtacagcagaagccggcaggccctgtgtggtgatgtataaagacactgagacggtccctcgagggtactcccgttgacgacggtactttccctcgttggccctacccggacggttaaccgaacggggaaccgtaaaccggggttaccaacgtaagtttcggggacccaaacgttcccgtaagggttacgggacgtacccgagggaccaagggaacgggaccggtaggccgtaggaacttaggttattacgtacgtaaattaccgaaaacacggtaaacaacccgtaagtttacgggttaaccttaagttcgttaccgtttacgggaaacttcggaaccgaaccgtaaacggttccgacccggttaccgttcggggttcccaacggccccgaaacgggaacccctaacccctagttccgttaaccgaacccgttttcccg

SEQ ID NO: 327987 - DNA, 617 bp, Homo sapiens
  misc_feature: GZ8MTXP01BCP2X.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggacaggatcacctgctctggagatgcattgaccaaaccgatatgcttattggtaccagcagaagccgggccaggcccctgtgttggtgatgtaataaagacacgtgagaacggcccctacgaggggactccctgacgcgtatttccctctggtcctcccgaggtaccgagggaaccaaacgggttcaacgactttagggccccaagttccgaggttgggacgttacccgagggccaaggagggaccgagggcctagactattaattgttacaatcaacagaccacagttaggtacttatcgtcttacggaacttggaccgaccgtaaaggttccgtaaccggttccggttcgggttccaacggtcccccgaaagggcccccaaaccccctacgttccgttaaccgaacctttccccg

SEQ ID NO: 327988 - DNA, 736 bp, Homo sapiens
  misc_feature: GZ8MTXP01AYBHA.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctcgtggagatgcattgaccaaaccgatatgtacttattggtaccagcagaacgccggcaggccctgtgtggtgtatgtaataaacgacacgtagaggacggtccctgaggggtactcccgtagacgcgtactttcccgtcgttggccttaccggaagggtacgaacggggtaacgtaaaccgggtcaaccgtaggtttcggaccctagtaccgtaaggtgggtaacgtaccgaagggaccgaaggaacggggaccggacggtaccgtagtaacttaagtttagtttacggtaccgtaaacgttacctaaacgaaccggtaaacctaacccgttaagtttaaccgggtttaaactttacggttagtttacccgtttaaaccgggaacgttaacggaccggttaacccgtaaaccgggttccgtaaaccccggttccggttacggggttacccgaccggtaaccccgaaaccggggaaccccctaaaacccccgtgttacccggtaaccgttaaccgtttcccg

SEQ ID NO: 327989 - DNA, 498 bp, Homo sapiens
  misc_feature: GZ8MTXP02J3L2A.52.42.D09.1.454.CMB.2.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgttggtgatgtataaagacactgagaggcccctnagggatccctgagcgattcctctggctccaggtcagggcaacggtcacattgccatcagtggagtccaggcagaggacgaggctgactattattgtcaatcaanagacaccattggacttatgtcttacggaactgacgacaaggtcaccgtcngggtcacgcccaaggcccaacccatctcactcc

SEQ ID NO: 327990 - DNA, 495 bp, Homo sapiens
  misc_feature: GZ8MTXP02JUITB.52.42.D09.1.454.CMB.2.raw
  modified_base (414)..(414): a, c, t, g, unknown or other
  misc_feature (414)..(414): n is a, c, g, or t
  modified_base (484)..(484): a, c, t, g, unknown or other
  misc_feature (484)..(484): n is a, c, g, or t
tcagcgcagtacgacacgaccggtgctcgatttagacacatacgcagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggcaggcccctgtgttggtgatgtataaagacactgagaggcccctgagggatccctgagcgattcctctggctcaggtcagggcaacggtcacattggccatcagtggagtccaggcagaggacgaggctgactattattgtacaatcaanagacaccattggtacttatgtctgaactgacgacaaggtcacgtcgcggtcacgccaacggcccaacccnctcgtcactcc

SEQ ID NO: 327991 - DNA, 503 bp, Homo sapiens
  misc_feature: GZ8MTXP02IGROY.52.42.D09.1.454.CMB.2.raw
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaacgntatgcttattggtaccagcagaagccgggcaggccctgtgtgngatgtataaagcactgagaggcctgagggatcccgtgagcgattcctctggctccaggtcagggacaaggtcactagttggccatcgagtgatcagcagaggacgnggctgaactattattgtcaaatnaaacagaacacattgtattatgtcgtcgaactgcgtaacaagttcaccgtctcgggtcacgaacccaaggacccaacccatcgtacactccc

SEQ ID NO: 327992 - DNA, 599 bp, Homo sapiens
  misc_feature: GZ8MTXP02JP5OM.52.42.D09.1.454.CMB.2.raw
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcaggcccctgtgttggnatgtataaagacactgagacggcctcgagggactcccgtagagcgtattccgtctgggctccaggtcgagggaccaaacgggtcactaagttcggaccagttaccagttggagtcccgagggacaaggaggaccggaaggtctacgacttatttattgtaccaaatacaaacagacaacctagttggtaacttattgtacgttacgaacttcgacgaacctaaacgggtcctaaccggtccgttacggggtaccaaccggaaccccgaaacgggacccccgaaaacccgtcctacggttacccaaccgtttccccg

SEQ ID NO: 327993 - DNA, 564 bp, Homo sapiens
  misc_feature: GZ8MTXP02H17GU.52.42.D09.1.454.CMB.2.raw
  modified_base (280)..(280): a, c, t, g, unknown or other
  misc_feature (280)..(280): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaacgatatgcttatggtaccagcagagccggcaggccctgtgtggnatgtataaagcactgagacgccctgagggatcccgtgagcgtatttccgtcgtcggcctccgaggtcgaagggaccaaacggtcaacgtagttcggcctaagtccgagtggacgttaccgaggacaggaggacgaggctaggacttagttaattgactaatcaaacagacactagtagttactatgtacgtacggaactcgacgtaaccgaacggtccaacccgttcgacgggttacaccggcccgaaacggaccccaaccccgacgtcgtaccaccgttcccg

SEQ ID NO: 327994 - DNA, 511 bp, Homo sapiens
  misc_feature: GZ8MTXP02FS3XM.52.42.D09.1.454.CMB.2.raw
  modified_base (238)..(238): a, c, t, g, unknown or other
  misc_feature (238)..(238): n is a, c, g, or t
  modified_base (399)..(399): a, c, t, g, unknown or other
  misc_feature (399)..(399): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatcccgtgagcgattcctctggctccaggtcagggcaacggtcacattgcatcagtgagtcaggcagaggacgaggctgactnttagttgtcaatcaacagacacctattgtactttatgtcttacgaaactgacgacaaggtcaccgtccgtcgggtcacgcccgaacggcccaaccccactcgtaccacttcc

SEQ ID NO: 327995 - DNA, 582 bp, Homo sapiens
  misc_feature: GZ8MTXP02F1W60.52.42.D09.1.454.CMB.2.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagcgcagtacgacacgaccggtgctcgatttagacacatacgcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtaataaagacactgagacggccctnagggactccctgagcgtattcctcgtggctccgaggtcagggacaacggtcacattggccaatcagtgatcgagcagagcgaggctgactattatgtacaaatcaaacagaacaacctattacggtaactttaatgttactttacgggaaaccttgaccgaaccgtaaacgggtcctaaacccggttcccgttgggggtacccaaaggcccccgtaaaacgggaccccctaaaaaccccccgtaccgttaccgtacccgtaccgttcccg

SEQ ID NO: 327996 - DNA, 508 bp, Homo sapiens
  misc_feature: GZ8MTXP02GRS3J.52.42.D09.1.454.CMB.2.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (495)..(495): a, c, t, g, unknown or other
  misc_feature (495)..(495): n is a, c, g, or t
tcagcgcagtacgacacgaccggtgctcgatttagacacatacgcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtataaagacactgagaggccctnagggatccctgagcgattcctctgctccaggtcagggcaacggtcacattggccatcagtggagtccaggcagaggacgaggctgactattattgtcaatcaacagacaccattggtactttatgttacttcggaactgcgaccaaggtccaccgtctcggtcagcccaaggcccaaaccccnctacgtcacttcc

SEQ ID NO: 327997 - DNA, 502 bp, Homo sapiens
  misc_feature: GZ8MTXP02JXX29.52.42.D09.1.454.CMB.2.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggccccctgtgttggtgatgtataaagacactgagaggccctnagggatccctgagcgattcctctggctccaggtcagggcaacggtcacattggccatcagtggagtccaggcagaggacgaggctgactattattgtcaatcaanagacaccattggtacttangtctgaactgcgacaggtcaccgtctcgggtcagtcccgaaggcccaacccactcgtacacttccg

SEQ ID NO: 327998 - DNA, 560 bp, Homo sapiens
  misc_feature: GZ8MTXP02HIWCV.52.42.D09.1.454.CMB.2.raw
  modified_base (239)..(239): a, c, t, g, unknown or other
  misc_feature (239)..(239): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgtggtgatgtataaagacactgagaggccctgagggatccctgagcgattcctctggctcaggtcagggcaacggtcacattgccatcagtgagtccaggcagaggacgaggctgactattatgtacaattcaaacagacaccattacggtacttagtgttcttacgggaacttcggacgaaccgtaacggtccaacccggttccgtacgggggttaccacggaacccccgaaacgggacccctaaaacccccgcgtacggtacctaacccggtttcccg

SEQ ID NO: 327999 - DNA, 545 bp, Homo sapiens
  misc_feature: GZ8MTXP02JYYFO.52.42.D09.1.454.CMB.2.raw
  modified_base (238)..(238): a, c, t, g, unknown or other
  misc_feature (238)..(238): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcagccctgtgtgtgatgtataaagacactgagaggccctgaggactcccgtgagcgtattccctctggctccgaggtcgagggcaacgggtcactagttggccatcagtggagtccaggcaggaggacgaggctgacttagttatgtacaatcgaaacagaaccacgtagtttaggtactttatgttaccgtttaggaaacttcggaccgtaaccgaacggttcccaaccggtccgtcgggtaccacggcccgaacggaccccacccacctcgtaccacttcc

SEQ ID NO: 328000 - DNA, 616 bp, Homo sapiens
  misc_feature: GZ8MTXP02ID3I8.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgttggtgatgtataaagacactgagacggccctgagggactcccgtagacgcgtattcccgtcgtggtctccgaggtccgaggggaccaaacgggtcaaacgtagttcgggacctagtccgaaggttgggacgtcccgaagggcaaggaggacgagggctagactatttattgtacaaatcaaacgagaaccacctagtttagtacttagtgtttacgttacggaaccttgaccgaaccgtaaacggttccgaaccgttccgtacggggttccaaccggtaaccccgaaaacgggacccccaaaaccccgtcggtaccgtacctaacctttcccg

SEQ ID NO: 328001 - DNA, 532 bp, Homo sapiens
  misc_feature: GZ8MTXP02I2M43.52.42.D09.1.454.CMB.2.raw
  modified_base (434)..(434): a, c, t, g, unknown or other
  misc_feature (434)..(434): n is a, c, g, or t
  modified_base (517)..(517): a, c, t, g, unknown or other
  misc_feature (517)..(517): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggcaggcccctgtgtgtgatgtaataaagacacgtgagacggcccctagagggactccccgtgacgcgtattccctcgtggctccgaggtccgagggactaacgggtcacgtattggccaagtcagtggagtccgaggcagaggacgagcgtgactattatgtacaatcaanagacaccgattagtacttagtgtacttggaactcgacgaccgaaggtccacgtcgtacggtacacgcccgaacgcccaacccngtcgtaccacgttcc

SEQ ID NO: 328002 - DNA, 688 bp, Homo sapiens
  misc_feature: GZ8MTXP02I7O66.52.42.D09.1.454.CMB.2.raw
  modified_base (235)..(235): a, c, t, g, unknown or other
  misc_feature (235)..(235): n is a, c, g, or t
tcagcgcagtacgacacgaccggtgctcgatttagacacatacgcagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtacagcagagccggcaggccctgtgtggtgatgtataaagacactgagaggccctgagggactcccgtgagcgtattcctcgtggtcctccgaggtcgaagggaccaaaccgggtcaaccgtaagttcggggaccctagttacaaggttcgggaacgtccgaaacggggcgaaaggaacggggaaccgaagggtccttaagggaacttaagtttaacgttaggtactaaaacttaccaaaacgaacggtaaacccgaaacccttaagtttacgggttaaaccttttaaaggttcgtttaccgtttaccgggaaaacctttcggtaaccggaaacccgtaaaacggggttcctaaacccgggttccgttacgggggttacccaacggtaaccccgaaacggtacccccgaaaacccccgtacgttaccgtaccctaccgtccg

SEQ ID NO: 328003 - DNA, 738 bp, Homo sapiens
  misc_feature: GZ8MTXP02IWQDK.52.42.D09.1.454.CMB.2.raw
  modified_base (238)..(238): a, c, t, g, unknown or other
  misc_feature (238)..(238): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgtggtgatgtataaagcactgagaggccctgagggactccccgtgacgcgtattcctcgtggcctaccgaggtccgaagggaccgaaaccgggttcaacgtagttcgggacccaagttccgaaggttcgggacgttcccgaagggccgaaggagggaccggaagggtccgtagggtaaaccttaagtttaagtttacggtaactaaaacgttaccgaaaactacgggaaaccctaaacccgtaagttttaacggggttaaccctttaaagttcggtttaaccgttttacggggaaaacctttcggaacccggtaaacccgtaaaacgggggttacccctaaacccgggtttccccggttaacgggggttcccaaaaccgggtaaccccccggtaaaaccggggtacccccctaaaaccccccggaacctttccggtaccccgttaaacccgttttcccccg

SEQ ID NO: 328004 - DNA, 543 bp, Homo sapiens
  misc_feature: GZ8MTXP02FWF4X.52.42.D09.1.454.CMB.2.raw
  modified_base (237)..(237): a, c, t, g, unknown or other
  misc_feature (237)..(237): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagacggccctcgagggatcccgtgagcgattcctctggctccgaggtcagggcaacggtcacattggccatcagtggagtccaggcagaggacgaggctgactattattgacaatcaacagacaccattaggtacttagtgtacttacgggaacttcgacgaacctaaacgggtccaacccggttcccgtaggggtccaacggcccgaaacggcccaaacccccatcgtaccacgtttcccg

SEQ ID NO: 328005 - DNA, 570 bp, Homo sapiens
  misc_feature: GZ8MTXP02GCV92.52.42.D09.1.454.CMB.2.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggtccctgtgtggtgatgtataaagacacgtgagacggcccctagaggggatccccgtagagcgtattcccgtcgtggctccgagggtccgaaggggaccaaacgggtcaacgtagttcggaccattcgagtggacgtccgaggcagaggcgaggctgactattattganaatcaanagacacctattggtacttatgtacgttacggaacttcgacgaaccgtacgtaccgaaccgttccgtacgggtccaacgcccgaaaacggacccaaacccccgtagtacgtaccacctttacccg

SEQ ID NO: 328006 - DNA, 665 bp, Homo sapiens
  misc_feature: GZ8MTXP02FRSC9.52.42.D09.1.454.CMB.2.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgtcttattggtaccagcagagccgggcacggccctgtgttggtnatagtaataaagacacgtggagacggccctagagggtactcccgtgagcgtattccctcgtcggctccgaggtaccgaacggggacaacgggtcaacgtagttcggaccctagtccgaggtggacgtacccgaggccgaagggaggaccggagggtcctaggtaaaccttagtttagttacggtactaaacgtaaccaaacgaacggtaaaccctaaccgtaagttttacggtaacttttaacgtgttaccgtttaacggtaaccgttacggaaccggtaacccgtaaacggtccctaacccggtttccgtacgggtaccaaccgccccgaaacggtacccccaaaccccgtcttaccgtaccctaaccgtttccccg

SEQ ID NO: 328007 - DNA, 652 bp, Homo sapiens
  misc_feature: GZ8MTXP02I3NWJ.52.42.D09.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtaccagcagaagcggcagccctgtgtgngatgtataagacactgagaggccctgaggactcccgtgacgcgtattcccgtctgggccctccgaggtccgagggaccgaaccgggtcacgagttcgggaccaatccgaagtggtacgtccggaaggccgaaggaggaccgagggccgtaggaaccttagtttaagttggtaactaaacttaccaaaacgtaggtaaacccaacctaagtttacgggttaaccttaattcggttaccgttacggtaaacgttacggacccgtaaaccgtaaacgggtacctaaacccggttccgttaacgggttccgaaccggtaacccccgaaaccgggtaccccaaaaccccctacggttaccgtacccaacgtttacccccg

SEQ ID NO: 328008 - DNA, 581 bp, Homo sapiens
  misc_feature: GZ8MTXP02GV80H.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgttggtgatgtaataaagacactgagacggccctgagggactcccgtgagcgtattcctcgtgctcgaggtcgagggacacggtcactagttcgcatcgagtgacgtcgaggcaggaggacgaggctagtacttagttattgtacaagtacaaacgtagaaccaacctagttacggttacttaagttcgttacgttacggaacttcggaccgtaaccgtaacggtcctaacccggtccgtacgggtaccacgaaccccgaaacggaccccaacccgactaccggtacctaacctttcccg

SEQ ID NO: 328009 - DNA, 508 bp, Homo sapiens
  misc_feature: GZ8MTXP02IIEQ0.52.42.D09.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
tcagcgcagtacgacacgaccggtgctcgatttagacacatacgcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccggccaggcccctgtgttggtgatgtataaagacactgagaggccctgagggatccctgagcgattccctctggctccaggtcaggggacaacggtcacgattggccatcagtggagtccgaggcagaggacgaggctagactattattgtcaatcaaacagaacacagttgtacttatgtcttcgaactgacgacgaaagtcaccgtccgtggtcacgcccgagacccaacccactcgtacactccg

SEQ ID NO: 328010 - DNA, 550 bp, Homo sapiens
  misc_feature: GZ8MTXP02JJ0PR.52.42.D09.1.454.CMB.2.raw
  modified_base (539)..(539): a, c, t, g, unknown or other
  misc_feature (539)..(539): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttattggtaccagcagaagccgggccacggcccctgtgtggtgatgtataaagacactgagacggccctgagggactcccgtgacgcgtattccgtcgtaggcctccgaggtcgaagggacaaacgggtcaacgtagttcggcctatcgagtaggacgtaccgaggcgaagggacgacggaggtctagacttagttatgtacaatacaagagactactagttggtacttatgtactacggactggacacgaacgtcaccgtcgtacgggtcacgaacccgacgacccacccgtancgtcacctccg

SEQ ID NO: 328011 - DNA, 552 bp, Homo sapiens
  misc_feature: GZ8MTXP02IVIKX.52.42.D09.1.454.CMB.2.raw
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggcaggcccctgtgtggtnatgtataaagacactgagaggcccctgagggactccctgagcgattccnctggctcgaggtcagggaccaacggtcaacngttcggccatcagtggatccgaggcagaggacgaggctgactattatgtacaatcgaaacagaacaccagtttaggtacttagtgttcttacggaaacttggaccgtaccgaaacggttccaaccggttccgtacggggtccaacggccccgaaacggacccctaaaaccccatcgtacactttcccg

SEQ ID NO: 328012 - DNA, 547 bp, Homo sapiens
  misc_feature: GZ8MTXP02JXAJ5.52.42.D09.1.454.CMB.2.raw
  modified_base (236)..(236): a, c, t, g, unknown or other
  misc_feature (236)..(236): n is a, c, g, or t
tcagcgcagtacgacacgaccggtgctcgatttagacacatacgcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggcaggcccctgtgttggtgatgtataaagcactgagaggccctgagggatccctgagcgtattcctgtggctccaggtcagggacaacgggtcactattggccaatcagtggagtccaggcaggaggacgaggctagacttattagttgtcaatacaacagaacacctaagttcggtacttagtgtcttacggaaactcggacgtaccaaacgggtccaaccggtcgtcgggtaccacggaaccccgaacggaccccaaacccctacgtcgtaccaaccttccg

SEQ ID NO: 328013 - DNA, 654 bp, Homo sapiens
  misc_feature: GZ8MTXP02F4YTV.52.42.D09.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgntatgcttattgtaccagcagaagccggcacggcccctgtcgttggtgatgtataaagacactgagaggccctacgagggactccctgacgcgtacttcctcgtggcctcgaggtaccgngggaaaaaccncgggtacactagttcggactagtccaaggttcggacgacgaggcgaggaacggcgaagggctaggacttatttagttagtactaactacaaacaacggtaaccacccgtaattacgggttaacctttattacgttacgtttaccgggtaaaacttcggaacccgttaaaccggaaacgggtaccgtaacccggtttccgttacggggtaccgaacccggtaacccggaaaaccggtacccccgaaaaacccccgtcttaccggtaaccctaccgtttacccccg

SEQ ID NO: 328014 - DNA, 605 bp, Homo sapiens
  misc_feature: GZ8MTXP02JT7DM.52.42.D09.1.454.CMB.2.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatgacagnagagccggcaggccctgtgtgtgatgtataaagacactgagacggccctacgaggactcccgtgacgcgtattcccgtcgtcggcctaccgaggtccgaaggggacctaaaccgggtcaaccgtagttcgggaccattcgaagtggacgtacccgaggcgaaggacggacgaggactagtacttattagttgtactaaatacaaacagaaccacctaagtttacggtatttagtagttcgttacggaacgttcgaccgtaaaccgaacgggttcccaacccggttccgtcggtaccgacgaaccccgaaacggtacccccaaaccccgtaactccgtaccaccgtttcccg

SEQ ID NO: 328015 - DNA, 575 bp, Homo sapiens
  misc_feature: GZ8MTXP02IXNF4.52.42.D09.1.454.CMB.2.raw
  modified_base (239)..(239): a, c, t, g, unknown or other
  misc_feature (239)..(239): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtataaagacactgagacggccctcgagggactccccgtgacgcgtactttcctcgtggctccgaggtccgaaggggaccgaacgggtcaacgtagttcgggaccagtcaggtgacgtccgaggcagaggacgaggctgactattattgtacaatcaacagacacctagttaggtacttagtcgttcgtacgtaactcgcgaaacgtacggtccaaccggttccgtacgggtacaccgaacccgaaacggaccccaaaccccctacgtccgtaccacgtttccccg

SEQ ID NO: 328016 - DNA, 535 bp, Homo sapiens
  misc_feature: GZ8MTXP02G7W88.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggcaggcccctgtgttggtgatgtataaagacactgagaggccctcgagggactccctgagcgtattcccgtctggctccgaggtcaggggacaacgggtcacagttcggcatcgagtggagtccaggcagaggacgagctgactattagttgtacaagtcaactagaacacctagttcggtactagttgtctacgaacttcgcgacgtaacgtcgaaccgtcgtacgggtcacggaacccacggacccaaccctatcgtaccactttcccg

SEQ ID NO: 328017 - DNA, 759 bp, Homo sapiens
  misc_feature: GZ8MTXP02IPJD9.52.42.D09.1.454.CMB.2.raw
  modified_base (238)..(238): a, c, t, g, unknown or other
  misc_feature (238)..(238): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagccggccacggcccctgtcgttggtgatgtaataaagacactaggagaacggcccctagacggggtactcccgtagacggcgtactttccctcgtcgggcctaccgagggtaccgacggggacctaaacggggttcaaaccgtagtttacgggccctaaacgttccgaggttcggaacggttaccccgaaggggacccaaggggaacgggaaccggaagggtcccgttaagggtaaccttaaggttttactttacgggttaaccaaaacgtttacccgaaaactaccggaaaacccttaccgtaacgttttacgggttaaacccttttaaggttacggttacccgtttacggggaaaaccctttcggaaccggtaaaccccggtaaaggtttaccccgaaaccccggtttaccggtttccggggtaaccaacccggttaaacccgaaccggtaaccccctaaaacccccggactacccggtaccttaacccgtttccccg

SEQ ID NO: 328018 - DNA, 682 bp, Homo sapiens
  misc_feature: GZ8MTXP02ISSM8.52.42.D09.1.454.CMB.2.raw
  modified_base (244)..(244): a, c, t, g, unknown or other
  misc_feature (244)..(244): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggactcacctgcctcgtggagatgcattcgaccaaacgntatgtcttatggacagcagagccggcagccctgtgtgtgatgtaataagacagtagagtacgcccctagaggtactcccgtagagctatttcccgtctcggccttaccgagggttacccgaaggggtaccgaaacgggttcaaacgtacgttacggccttaaagccgtaaagggttggaaacgttcccgaaaggggccgtaaaggacgggaacggttaagggccttaagggtacttaaagtttaagtttaaacgtaaactaaacgtaaccaaaacaacgtaaaccgtaaccgtaacgtttaacggtttaacgttaacgttacgttacgttaccgtaacgtacggtaccgaaaccgtaacgtaccgtaccggttaccgtaccggtaccgaccgaacccgaaccgaacccgaacccgtaccgtaccgtaccgtacctccg

SEQ ID NO: 328019 - DNA, 509 bp, Homo sapiens
  misc_feature: GZ8MTXP02HR2QV.52.42.D09.1.454.CMB.2.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactcctctgcacaggctctgaggtcctcctatgagctgacacagccacctcggtgtcagtgtccccaggacagacggccaggatcacctgctctgganatgcattgaccaaacgtntatgcttatggtaccagcagaagcggcaggcccngtgtgngatgtataaagacactgagaggcctagagggatccctagagcgtatcctctggcctcaggtcaggggcaaacgggtcaacagttgacctatcagtgagtccagcagagacgagctagactatattgacaatcaanagaaccanatggtaactagtgtacttcgaaactcgcgaacaacgttcaacgtcgtcgggtcacggccaagacccaacccacgtctaccaactcc

SEQ ID NO: 328020 - DNA, 531 bp, Homo sapiens
  misc_feature: GZ8MTXP02JK8MK.52.42.D09.1.454.CMB.2.raw
  modified_base (238)..(238): a, c, t, g, unknown or other
  misc_feature (238)..(238): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggcccctgagggactccctagagcgtattccctctggctccgaggtcgagggaccaacgggtcacgtagttggccatcagtgagtccaggcagaggacgagcgtagactattattgtacaatacaacagacactattaggtacttatgtcttacggaattcgacgacaacggtccaccgtcgtacggtcacgcccgaaggaccccaaccgactacgtccactttccg

SEQ ID NO: 328021 - DNA, 615 bp, Homo sapiens
  misc_feature: GZ8MTXP02GBQVD.52.42.D09.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (460)..(460): a, c, t, g, unknown or other
  misc_feature (460)..(460): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgtcttattggtaccagacagaagccggaccacggcccctgtgttggtgatgtaataaagacacgtaggagacggccctacgaagggacttccccgaggaacgcgtacttcccgtcgtcggcctccggtaggtacgacgggacaacggtcacagttcggacatcagtacggacgtaccgaggacaaggacggacgtaggctagtaactgtttaaagtttntaaactaactacaacgacacctaaccgtagtttacgttacttagttcgtacgtacgtaacgtacgtaccgaacgtaacggtaccgtaccgtccgtacggtccgaaccgaacccgaaccgtaccccaacccgtacgtaccgtaccctacgttcccg

SEQ ID NO: 328022 - DNA, 617 bp, Homo sapiens
  misc_feature: GZ8MTXP02ID5NF.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggccaggcccctgtgttggtgatgtataaagacactgagacggccctgagggactcccgtgacgcgtattcctcgtcggctccgaggtcgagggacaacggtcactagttcggccatcagtgagtccgaggcagaggacgagctgactattagttgtacaatcaaacacgtaactacctaagtttcggttaactttagttacgttacgtttacggaaacgttacggaccgtaaaccgtaaacggttacccgaacccggtttaccggtcggggttaacccaacgggtaaccccccgaaaacgggacccccaaaaccccccgtacttcccggttacctaacccgtttcccccgg

SEQ ID NO: 328023 - DNA, 604 bp, Homo sapiens
  misc_feature: GZ8MTXP02HDFIR.52.42.D09.1.454.CMB.2.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (429)..(429): a, c, t, g, unknown or other
  misc_feature (429)..(429): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtgngatgtaataaagcactgagacgccctgagggactcccgtgacgcgtattcctcgtggcctaccgaggtcgaagggaccaaacggtcaacgagttcggaccagtcagtgaacgtccgaggacagaggacgaggctagacttagttatgtanactacaacagtaacacctagttcggtaacttagtcgtacgttacggaacttcgaccgtacctaaacgggttccaaacccggtttccgtacggggttaccaaccgggtaacccccgtaaaacggggccccctaaaacccccggtacttaccggtacccctaaaccttttcccccgg

SEQ ID NO: 328024 - DNA, 536 bp, Homo sapiens
  misc_feature: GZ8MTXP02JJG0J.52.42.D09.1.454.CMB.2.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (420)..(420): a, c, t, g, unknown or other
  misc_feature (420)..(420): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgacagcagagccggcaggcccngtgtggnatgtataaagcactgagacggccctgagggactcccgtgagcgtattcccgtcgtggctccgaggtcgagggaccaacgggtcaacgtagttcggcctatcgaagtggagtccgaggcagaggacgaggctagactattatgtanaatcaaacagacactagttgtactatgtcttcgaactcgacgtaacgaacgtcaaccgtccgtagggtccacgaaccccgaacggcccaaaacccgtcgtaccgtaccacttcccg

SEQ ID NO: 328025 - DNA, 585 bp, Homo sapiens
  misc_feature: GZ8MTXP02HVOHQ.52.42.D09.1.454.CMB.2.raw
  modified_base (239)..(239): a, c, t, g, unknown or other
  misc_feature (239)..(239): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccacctcggtgtcagtcgtccccaggacagacgccaggatcacctgctctggagatgcattcgaccaaaccgntatgcttatggtaccagcagaagccggcacggccctgtgttggtgatgtaataaagacacgtgagacgccctacgagggactccgtgagcgattcctcgtgctccgaggtcgaacgggactaacgggtcactagttacggaccattacgagtggacgtccgaggcaaggacggacgagggctaggtacttaattagttacggtactaattacaaacgaggtaacaccgtaagttaggttaacttacgtattaccgtttacggaaacttcgaccgtaccgaaacggtcctacccggttcgtacggtcgaacgcccgaacggacccaacccgatccgtactactcccg

SEQ ID NO: 328026 - DNA, 600 bp, Homo sapiens
  misc_feature: GZ8MTXP02IXK2F.52.42.D09.1.454.CMB.2.raw
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggcaggcccctgtgttgngntgataaagcactgagacggccctacgagggactcccgtagacgcgtattccctcgtggctccgaggtcagggacacggtcacgattcggccatcaagtgtacgcgaaggcaggaggaccgtaggcgttagacttagttagttacgtacaactacaaccgaagaacctaacccgtaagtttacggttaactttaagttcggttaacgtttacggaacttacggtaccgaaaccgtaaacgggtcctaacccggttccgtacgggtacgaccgaacccgaacggaccccaaccccgtagtaccgtccaccgtttcccg

SEQ ID NO: 328027 - DNA, 715 bp, Homo sapiens
  misc_feature: GZ8MTXP02F3TKG.52.42.D09.1.454.CMB.2.raw
  modified_base (237)..(237): a, c, t, g, unknown or other
  misc_feature (237)..(237): n is a, c, g, or t
  modified_base (279)..(279): a, c, t, g, unknown or other
  misc_feature (279)..(279): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtggngatgtataaagcactgagaggccctagagggatccctgagcgtacttcctcgtggctccgaggtccagggctaacgggtcaacgtagttcgggactagtccgaggtcggaacgttcccgaagggccaagggaacgggaccggaagggtcgttacggaaccgtttaagtttaaacgtttcggtaacctaaaacgtttccaaaaaccgaacgggtaaccctaaaccccgttaagttttacggggttaaacctttaaagttcggtttaccgtttaaccggggtaaaacttcgggaacccgtaaaccgtaaaacgggttaccctaaaacccggggtttccctacgggggttacccaacccgggtaacccccgtaaaaacggggcccccctaaaaacccccggtacctttaccgggtaccccctaaaccggttttcccccg

SEQ ID NO: 328028 - DNA, 488 bp, Homo sapiens
  misc_feature: GZ8MTXP02I9B36.52.42.D09.1.454.CMB.2.raw
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattgacagcagagcggcaggccctgngtgtgntgataagcactgagaggccctgagggctccctgacgcgattcctctggctccgaggtcagggcacggtcacattggccatcagtgagtcaggcagaggacgaggctgactnttatgtacaatcaatagaacaccattggtacttatgtactcgaactgcaacgaggtcaccgtcngggtccaggcccaaggcccaacccngtacnccactcg

SEQ ID NO: 328029 - DNA, 492 bp, Homo sapiens
  misc_feature: GZ8MTXP02GVYHG.52.42.D09.1.454.CMB.2.raw
  modified_base (237)..(237): a, c, t, g, unknown or other
  misc_feature (237)..(237): n is a, c, g, or t
  modified_base (416)..(416): a, c, t, g, unknown or other
  misc_feature (416)..(416): n is a, c, g, or t
  modified_base (484)..(484): a, c, t, g, unknown or other
  misc_feature (484)..(484): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcattgaccaaacgntatgcttatggtaccagcagaagccggcaggtccctgtgtggtgatgtataaagacactgagaggccctgagggactcccgtagagcgtattcctctggctaccgaggtcaaggggacaacggtcacgtatggccatcagtgagtcaggcagagcgaggctagactattattgacaatnaacagacaacagttacgattaatgtctagaactgcgacaaggtcacgtcagtcagccaagccaaaccntcacactc

SEQ ID NO: 328030 - DNA, 625 bp, Homo sapiens
  misc_feature: GZ8MTXP02IB5PZ.52.42.D09.1.454.CMB.2.raw
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
  modified_base (452)..(452): a, c, t, g, unknown or other
  misc_feature (452)..(452): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcacgcccctgtgttggngatgtaataaagacactgaggtacggtcctacgagggtactcccgtagacgcgtattcccgtcgtggtctccgagggttaccgaaggggacgtaaaccggtcaacgtagttcgggacctagtcgagtggacgttacgacggacgagacgggacggtaggctaggactntttaagttgtaacaacgttacaaacgagaccaacctagtttacgtactttaagttgttaccgttagtaactcggacgaaccgtaacgtcctaacccggttcgtacgggttaaccaccggaacccgaaaacggccccctaaaacccgtacgtaccgttaccgtaccctttcccg

SEQ ID NO: 328031 - DNA, 524 bp, Homo sapiens
  misc_feature: GZ8MTXP02ILLVC.52.42.D09.1.454.CMB.2.raw
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaacgatatgcttattggtaccagcagaagccgggcaggtcctgtgtggnatgtaataaaagacactgagaggcccctagagggactccctgagcgtattcccnctggctccgaggtcaagggacaaacgtnaacattggacatcagtgagtcaaggcaagaggacgaggctagatattatgtanaaatcaaananacacatagtatatntatacgtacgtacgacgaacgaacgtacgaccgtacgtcgtacgacgaaccgaaccgaaccaacccacctacgtactactc

SEQ ID NO: 328032 - DNA, 628 bp, Homo sapiens
  misc_feature: GZ8MTXP02HYDQB.52.42.D09.1.454.CMB.2.raw
  modified_base (217)..(217): a, c, t, g, unknown or other
  misc_feature (217)..(217): n is a, c, g, or t
  modified_base (281)..(282): a, c, t, g, unknown or other
  misc_feature (281)..(282): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcnggagatgcattgaccaaacgatatgcttatggtaccagcagaagccggcaggccctgtgttggnntgtataaagacactgagaggccctagaggggactcccgtgacgtcgtattccctcgtgggtcctaccgaggtccgaaggggacctaaacgggtcaaccgtagtttcggccaaagttccgaggttaggacgtcccgaagggccaggaacgggacgaggacctaggtaccttaatttagttggtacctaaattacaaacgtaacgacaaccctaagtttacggttaacttagttcgttacgttcggaaaacttcggacgtaacccgtaaggtccaaccggttccgtagggtacccacggaaccccgaaacggaccccaaaacccctcgtaccggttaccaacttcccg

SEQ ID NO: 328033 - DNA, 543 bp, Homo sapiens
  misc_feature: GZ8MTXP02HLL6Q.52.42.D09.1.454.CMB.2.raw
  modified_base (286)..(286): a, c, t, g, unknown or other
  misc_feature (286)..(286): n is a, c, g, or t
  modified_base (530)..(530): a, c, t, g, unknown or other
  misc_feature (530)..(530): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggnatgtaataaagacactgagaggccctcgagggactccctgagcgtattcccgtctggcctcgaggtacgagggacaacggtcactagttcgacatcgagtgacgcgaggcagacgagcgactgacttattagtataacatacaacgagtaccacttagttgtaaacttgtacgttacgtacgtaacgtcgaaccgacgtacgacctaccgtccgtcggacgaccgaaccgacgacccaaacccntcactacttcccg

SEQ ID NO: 328034 - DNA, 616 bp, Homo sapiens
  misc_feature: GZ8MTXP02JIYEZ.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggatcacctgctcgtggagatgctattcgaccaaacgatatgtcttattcggtacagacagaacgccggacacggccctgtgttggtagatagtaataaagacacgtagaggacgccctagaggactccgtagacgcgtattccctcgtcggcctacggacggtacggaacgggacgtaaccggtactaacgtacgtacgacctagtacgtaggtacggtacgacggaggacgaagggacggacgaggtacgtacgtaacttagttagtacgtaactaactacaaacgaacgtaacctaaccgtagtttacggttaactttacgtacgttacgtacgtaacgtcggaccgtaaacgtacgtccgaaccgtcgtacggacacgaaccgacgacccaccgctcgtacacttacc

SEQ ID NO: 328035 - DNA, 637 bp, Homo sapiens
  misc_feature: GZ8MTXP02IJDVK.52.42.D09.1.454.CMB.2.raw
  modified_base (237)..(237): a, c, t, g, unknown or other
  misc_feature (237)..(237): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgctctggagatgcattgaccaaacgntatgcttatgtaccagcagaagccggcaggccctgtcgtggtgatgtaataaagacactgagaggcccctagagggactcccgtgacgcgtattcctcgtggctaccgaagggtaaggactacgggtcaacgtagttcggaccctagtacctagggtcggtaacgtcccgaagggccgaaagggaacggggacggaagggtaccgtaggaaactttagttaacgttgtaactaaattacgaaaacaacgtaaccaaccttagtttacggtaaactttagtacgttacgttacggaaactcgtaccgaaaccgtaaggtaccctaaccggttacgtcggggtaccaaccgacccgaaacggaccccaaacccctcgtacgtacccaacttccgttaccccg

SEQ ID NO: 328036 - DNA, 651 bp, Homo sapiens
  misc_feature: GZ8MTXP02HE41G.52.42.D09.1.454.CMB.2.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagaacgccggcacggccctgtgtggngatgtaataaagacacgtagagacggccctacgacgggtactcccgtaggacgtcgtacttcccgtcgtcggtacctaccgtacggtacgaacggggacctaaaccgggttacacgtagttcggacctagtccgaaggttggacgtaccgagggacgaaggggtacgggacggggtctagtaacttagttagttacgtactaaacgtacaaaacgacgaacctaacctagttacggttacttagttcgttacgttacggtaacgtcggaaccgaaccgtaagggtccctaaccggttcgtacggggtacccaccggaacccgaaccggaccccaaacccgtacgtaccgtcctacctaccgtttacccccg

SEQ ID NO: 328037 - DNA, 656 bp, Homo sapiens
  misc_feature: GZ8MTXP02GN8Y3.52.42.D09.1.454.CMB.2.raw
  modified_base (221)..(221): a, c, t, g, unknown or other
  misc_feature (221)..(221): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccgggccaggcccctgtcgtggtgatgtataaagacacgtgagacggccctagagggacttcccgtgacgcgtattccctcgtggcctaccgaggtcaagggtaccaacgggtcaactagttcgggaccctagtccaaaggtggtacgtcccgaaggaccgaaggaacgggaccgaagggcccgttaagggaacctttaagtttaacgttaggtaacctaaacttacgaaaacctaggaaacctaaccctaagtttacggttaacctttagtacgttacgttaacggtaactcggaccgtaaacgtaacggtaccgtacccggtaccgtacggtacaccggaacccgtaaaccggaccctaaaccccggacttaccggtacctaaccttcccg

SEQ ID NO: 328038 - DNA, 586 bp, Homo sapiens
  misc_feature: GZ8MTXP02JQK4P.52.42.D09.1.454.CMB.2.raw
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgacttatggtaccagcagaacgccggcacggcccctgtgtggtgatgtataaagacactggagacggcctcgagggactcccgtgacgcgtattccctcgtgcctcgaggtcgacgggacaacggtcacgtagttcggcctagtcagtcggacgtcgagggcaggacgcggagctgactattatgtacaatcgaaacagaacacctagttaggtacttagtcgttcgtacggaactcggaccgtacgtaacggtccacccggttccgacggggttaccaccggtaaccccgaaccgggaccccctaaacccccgtacgttaccggtacccaaccgtttccccg

SEQ ID NO: 328039 - DNA, 629 bp, Homo sapiens
  misc_feature: GZ8MTXP02GJIIR.52.42.D09.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgganatgcattcgaccaaacgntatgcttatcgacagcagacgccggcacgccctgtgtgnatagataaagcagtgagacgcctagaggctccgtgacgcgtattcctcgtcggtctaccggagggtaccgggaacgtacgggtacacgtagtcggtaccgacgtacgtacggtaggtacggtaccgacgggacggagggaacgggtaacgggacggtacgtacgtaacgtttagttacgtttaggtaactaacttaacgaaactaacgaaccaacgtagtttacgtacgttattacggtcttacggacgtacgaaccgtacggtaacgtccgtaacccggtccgtacgggtccgaaccgacccgtaaccgacccgtaacccgtacgtactaccttacccgtacgttccccg

SEQ ID NO: 328040 - DNA, 597 bp, Homo sapiens
  misc_feature: GZ8MTXP02GF28C.52.42.D09.1.454.CMB.2.raw
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (459)..(459): a, c, t, g, unknown or other
  misc_feature (459)..(459): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaacgntatgcttagttcggtaccagcagaacggccgggcacggcccctgtgtggngatagtaataaagacactaggacgaggcccctagacgggacttcccgtagagacgtattccctcgtcggcctaccgtagggccgaacggggacaaaccgggtcaaactagttcggacctattcgaaggttaggaccgtacgaaggacaagggacggacgaggacgtanaaaccttatttaagtgtaaacaatcgaaacagaaccactagttcgtactattgtacgttagaactcggacaccgaaaggtcccaacgttcgtacggaccacgtaaccgaacggtaccaaccgctcggacacttacccg

SEQ ID NO: 328041 - DNA, 811 bp, Homo sapiens
  misc_feature: GZ8MTXP02IUD37.52.42.D09.1.454.CMB.2.raw
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatccacctgctcgtgganatgctattgacccaaacgtatatgctttagttcggtaccagccaggaagccgggcacggcccctgtgtggtnatgtaataaagcactgagacggccccttacgagggtactaccccgtaggacgtacgactttcccgtcgtcggtctaccccggaggttaccggaacggggtaccgtaaaccgggtctaacccgtaagtttccgggaccctaagttacccgtaaggggttcgggaacgttcccggaaagggcgtaacgggaacgggaccggagggtacccgtagggtaaaccttaagtttaagttaccggttacaaaacgtttacgaaaaccgtaggaaaccccgtaacccgttaaagtttaccgggtttaaactttaacgtttccggttaaccgttttaaccgggaaaccgtttcggtaacccgggaaaccgttaaaccgggggttaccccgtaaacccggggtttcccgtttaacgggggtaacccgttaacccggaaacccccggtaaaacggggtaccccccctaaaaacccccgttaaccggtttacccggttaccccggttaaaaccctttttacccccggg

SEQ ID NO: 328042 - DNA, 644 bp, Homo sapiens
  misc_feature: GZ8MTXP02FWK8L.52.42.D09.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtgganatgcattcgaccaaaccgatatgtacttagttcgtaccagcgagacgccggcacggccctgtgtgtgatanataagacagtgagacgccctagaggactccgtagacgtcgtattcccgtcgtcggtctaccgaggtaccgaggggaccgtacggtaccaagtacgttccgggactagtcccgtaggtacgggactaccggaaggcgaaagggaggaccggaggccgtaggtaaaccttagtttacttacgtacaaacgtacgaaacacggtaaacctaccgttaagtttacggttaactttagtccgtttacgtacggaacttcggaaccgtacgtacggtaccctaccgttccgggtacgccgaaacgaacccccgaacgaaccccgaaccccgtagtccgttacaccgtttacccg

SEQ ID NO: 328043 - DNA, 585 bp, Homo sapiens
  misc_feature: GZ8MTXP02GB129.52.42.D09.1.454.CMB.2.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgtcttatggtaaccngcagacgccgggtcacggccctggtcgttgtgatagtaataaacgcacgtagaggacggtccctagcgggtactccgtagacgcgtacttccgcgtcgctccgtaggtcgagggactacggcacgtctcgactgtcagtgacgtcgagnaggagcgnggtactgattagttacttagaactagtaacaaacgacgacctaaccgtagtttacggttaaactttagtccttacggttacgtaaactcggaccgtacgtaacgtccgtaccttcgggaccgtacgacaacccgaaccgcccaacccgtaacgtccgtacacctttcccg

SEQ ID NO: 328044 - DNA, 594 bp, Homo sapiens
  misc_feature: GZ8MTXP02G6V3B.52.42.D09.1.454.CMB.2.raw
  modified_base (468)..(468): a, c, t, g, unknown or other
  misc_feature (468)..(468): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacgccaggatcacctgctcgtggagatgcattcgacccaaacgatatgtcttagttggtaccagcagaacgccgggccacggcccctggtgttggagtatagtaataaagactacgtagagacggccctacgacgggtactcccgtagagcgtattcccctcgtcggcctcggaggtaccgacgggaccgacgtacacgtagtccggacacgtcgtaaggtggtacgaccggaggcgaagggacgggacggagtctagtacttatttaggtntaacatacaactagaaccacgtagttacgttatgttccttagtacgtagacgtacgaaacgtacggtaccacgttcgtacggacaccgaaccgaaccggaccccactacgtctaccctattccccg

SEQ ID NO: 328045 - DNA, 645 bp, Homo sapiens
  misc_feature: GZ8MTXP02FGR95.52.42.D09.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtccagtgtccccaggacagacggccaggatcacctgctctgganatgcattcgccaaacgatangtcttattggtaccagcagaagccgggccgacggcccctgtggttggtgagtagtaataaagacactgagacggccctacgagggactcccgtggagcgtattcctctcggcctccgaggtacgacgggacgacgacacgtagtcgcatcgaggtgacgaccgaaggcaaggacggacggagcgtagaacttaagttagttagaacaataccaaacgaacgaacctaccgtagtttacgttaacttacgtacgttaccgtttacgggaaaccttcggaaaacccgtaacggttaaccgggtaaccgtaccccggtttaccgggtacggtaaccggaaacccggtaacccgaaacccggaccccctaaaacccgtaccgtttaccggaaccctcctttaccccg

SEQ ID NO: 328046 - DNA, 638 bp, Homo sapiens
  misc_feature: GZ8MTXP02HQG6V.52.42.D09.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
  modified_base (439)..(439): a, c, t, g, unknown or other
  misc_feature (439)..(439): n is a, c, g, or t
tcagcgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtgganatgctattcgacccaaacgnttangtacttagtcggtaccagcagaacgccgggccaggccctgtcgtggtnatagtataagacacgtggagcggcctgacgggtactccngacgcgtattccctagtcggcttacgagtccgagggctaacgggtcaacgtgttcgcctagcgtaggtcggacgtcccgagggcgaagtacgggacgtacgggngtacgtacgttagttacgtcgtaactaacgtaacaacgacgtaacctacgtacgttacgtttaacgttacgttacgttaccgttaacgtaacgtcggtaaccggtacggtaccggttacccgtaccggtccggtacggtaccgacccgtaacccgaacccggacccctaacccgacgtttaccgtaccttaccgttccg

SEQ ID NO: 328047 - DNA, 604 bp, Homo sapiens
  misc_feature: GZ8MTXP01DCTYR.45.74.G08.1.454.CMB.2.raw
  modified_base (189)..(189): a, c, t, g, unknown or other
  misc_feature (189)..(189): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagcttgggttttcctcgttgctcttttaagaggtgtccagtgtcaggtncagctggtggaggtcgggggagcgtggtccagcctgggcgtcgctgagactctctgtataggttctggattcaccttnaagngtcatggactgcacgtgggcccnccacggccccaggcgaaggggctggactgggctgggactagttacgtcatanggataggaaataaatcaataaccgtacggcgtactccggtagaacggggcctaattcaccgtatccgtaccaagacgaactaaacttacccaaagtaaccacgggtaatactaccttaaccgaaagttcgggaacaacggtccctggaccggagaccgtaggaacggaccgacggtctaagtgttaccttnggtcgacgaggngttaggtttggtagggttcgggtattacgtttacggaaccgttcgggttaacccg

SEQ ID NO: 328048 - DNA, 575 bp, Homo sapiens
  misc_feature: GZ8MTXP01A81QT.45.74.G08.1.454.CMB.2.raw
  modified_base (172)..(172): a, c, t, g, unknown or other
  misc_feature (172)..(172): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtggaggtcggggggagcgtggtccagccgtgggcggtcgctgagactctctgtataggttcnggattcacttnaagngtcatggactgcacgtcgggtcccgccacggcccccgagggaccgaagggggctgggactgggctgggactagtttacgtcatacgtgagtaggaaagtaaatcaataaccgtacggcggactccggtagaacggggcctataccaccatctaccagagacaactaccaaagaacacggtatactactaccaaatggacagcctgcgagcgtgaggactacggctgtcgttactgttgtcgacgaggttagttaggtttgggtaggtcgggtattagttttcgaacgttcggttaaccccg

SEQ ID NO: 328049 - DNA, 587 bp, Homo sapiens
  misc_feature: GZ8MTXP01A63S2.45.74.G08.1.454.CMB.2.raw
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggcggtcgctgagactctcctgtataggttctggattcaccttcaagntcatggactgcacgtgggtcccnccaggccccaggcagggggctggactggctggctagtacgcatatgatggaaataactcataacgacggccgggtactccggtaggaacggggccctattccaacctatcctccgaagagaacctaattaccaaagaacgacggtagtactctaccgaaaagtcgggaacagccctgcgagcgtcggacggacgacggtctggtcgttacttccttggtcgacccaggttaggttaggtttaagggtagggtaacgggtattacgtttcgaaccgtttcgggttaacccg

SEQ ID NO: 328050 - DNA, 524 bp, Homo sapiens
  misc_feature: GZ8MTXP01CGXYI.45.74.G08.1.454.CMB.2.raw
  modified_base (272)..(272): a, c, t, g, unknown or other
  misc_feature (272)..(272): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggcggtcgctgagactctcctgtataggttctggattcaccttcaagngtcatggactgcacgtgggtcccgccaggccccaggcaagggggctggactgggctggctagttacgtcatatgatggaataaatcatcgacgcggactcgtgacgggcatcacatctcanagacataccaagacagtnatcacaagtgacagcctgcgagctggaggcgacggtctgtcgttacttcttgtcgcgaggttacgttaggtttgggtagggtcgggtattgtttcgaacgttcggttaacccg

SEQ ID NO: 328051 - DNA, 627 bp, Homo sapiens
  misc_feature: GZ8MTXP01D6V3L.45.74.G08.1.454.CMB.2.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (458)..(458): a, c, t, g, unknown or other
  misc_feature (458)..(458): n is a, c, g, or t
  modified_base (542)..(542): a, c, t, g, unknown or other
  misc_feature (542)..(542): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtggtggaggtcggggggagcgtggtccagccgtgggcggtcgctgagactctctgtataggttcnggattcactnaagntcatggactgcacgtgggtcccnccaggccccagggcgaagggggctggactgggctggctagttcgcagtanggataggaaataaactcaataaccgtacggacgggaacctcccggtaggaacggggcccgtattccacctatctacgaagacgaactaacgttaccaaagaaccacgggttntaacttcctaaccgaaagttcggggaacctacggcctacggcggagccgtaggacggaccacgggtcttaaggtgttaccgttnttcggtcggaccaagggttgggttaggtttggggtacggggtcggggttattaggttttcggaacgtttaacgggtttaaccccg

SEQ ID NO: 328052 - DNA, 619 bp, Homo sapiens
  misc_feature: GZ8MTXP01DCMD9.45.74.G08.1.454.CMB.2.raw
  modified_base (191)..(191): a, c, t, g, unknown or other
  misc_feature (191)..(191): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
  modified_base (530)..(530): a, c, t, g, unknown or other
  misc_feature (530)..(530): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagcttgggttttcctcgttgcttcttttaagaggtgtccagtgtcagggtncagcgtgggtgggaggtcggggggagcgtggtccaggccgtggggcgtcgctgagactctcgtgtataggttctggattcacctnaagntcatggactgcacgtgggcccaccaggccccaggacgaagggggctgggactgggctgggctaggtttacnatntggatagggaaataatcgaattcgacgcggtaactccggtaggaacgggtcattaccaactntcncagaanaacactacaacgaatacggtntacgtacctacgaaaacgtggaacaccgtcgtagccgtagcgtaggaaccggcgaacgggtcgttaaggttcttaccgtttcgnggttccgacttaagggttgtttaagggtttggggtaaggggttcggttaatttacggttttcggtaaccgtttaaccggggtttaaccc

SEQ ID NO: 328053 - DNA, 514 bp, Homo sapiens
  misc_feature: GZ8MTXP02HDB5C.45.74.G08.1.454.CMB.2.raw
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (469)..(469): a, c, t, g, unknown or other
  misc_feature (469)..(469): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctgggcgtcgctgagctctctgtatggtctggatcacttnaagagtcatggactgcactgggtccnccaggccccaggcaaggggctggactggctggcagttcgnatangatggaataatcatactacgcgactccgtagaacgggcctatcacatcncagagacaactacaaaccccgaanacgtagtatctaccaaagtcgacagcctgcgagctgagacgacggctggtgttactctgtcgcagngtagttggtagggtcggtattagtttgtacgttacggttaacccg

SEQ ID NO: 328054 - DNA, 547 bp, Homo sapiens
  misc_feature: GZ8MTXP02JF2AV.45.74.G08.1.454.CMB.2.raw
  modified_base (395)..(395): a, c, t, g, unknown or other
  misc_feature (395)..(395): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcgggggagcgtggtccagcctgggcggtcgctgagactctcctgtataggttctggattcaccttcaagagtcatggactgcacgtgggtcccgccacggcccccaggcgaaggggctggactgggctggcagttacgcatatgatggaaagtaatcaatctacgcgactccgtagaacgggccatcacatcncagagacaatccaaagaacacggtagtaatctaccaaatcggacacgcctgacgagcgtgaggacgacggctggtgtacttcgtgtcgaccgaggtagtaggtttggtaacgggttcggtaagtttgtttacgtacgttcggtttaaccccg

SEQ ID NO: 328055 - DNA, 601 bp, Homo sapiens
  misc_feature: GZ8MTXP02GY190.45.74.G08.1.454.CMB.2.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggcggtcgctgagactctcctgtatggttctggattcaccttcaagagtcatggactgcacgtgggtcccnccacggcccccaggcgaagggggctgggactgggctggcagttcgtnatatgatggaagtaaatcatacgtacgcggactccgtgaacgggcctattcacctatcctacgagacgactaacttaccaaagaacgacgtgtaactcgtaaccaaagtcggacacggtacctggccgagcgtaggaggacacggcttgtacgttacttcgtcgtacgaccgtaaggtacggttaacggtttaagggtacgggggttacgggttatttaacggttttcggtaacccggtttacgggtttaaccccgg

SEQ ID NO: 328056 - DNA, 559 bp, Homo sapiens
  misc_feature: GZ8MTXP02JVXMS.45.74.G08.1.454.CMB.2.raw
  modified_base (274)..(274): a, c, t, g, unknown or other
  misc_feature (274)..(274): n is a, c, g, or t
  modified_base (369)..(369): a, c, t, g, unknown or other
  misc_feature (369)..(369): n is a, c, g, or t
  modified_base (409)..(409): a, c, t, g, unknown or other
  misc_feature (409)..(409): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggcggtcgctgagactctcctgtataggttctggattcaccttcaagngtcatggactgcacgtcggggtcccgccgacgggcccccagggccgaagggggctgggactgggctggctagttacgcatatgatggaaagtaancaatcgtacgcgactccgtagaacggcctatccaccatcncagagacactaccaagaacacgtcgtatctacaagtgacagcctgacgagcgtggacgacgacggtctgtcgtacttcgtagtcgaccgagtaggtaggtttgggtaggggttacggtattagttttacggtacgttacggttaaccccg

SEQ ID NO: 328057 - DNA, 555 bp, Homo sapiens
  misc_feature: GZ8MTXP02JMN7E.45.74.G08.1.454.CMB.2.raw
  modified_base (469)..(469): a, c, t, g, unknown or other
  misc_feature (469)..(469): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggcgtcgctgagactctctgtataggtctggattcaccttcaagagtcatggactgcacgtgggtccgccaggccccaggcaaggggctggactggctggcagttacgtcatatgatgaaagtaatcatactacgcgactcgtgaaacgggccattcacatccgacagagactaatacccaaagaacacggtatactactacaaaatggaacagcctagccgagcgtagaggacgtacgctggtnttactcgtggtcgccgaaggtagtaggtttaaggtacgggggttacgggtaatttagttttacgaacgtttacggtttaaaccccg

SEQ ID NO: 328058 - DNA, 642 bp, Homo sapiens
  misc_feature: GZ8MTXP02HDQJ5.45.74.G08.1.454.CMB.2.raw
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggcggtcgctgagactctctgtataggttctggattcaccttcaagngtcagtggactgcacgtcggtccaccgacggcccccaggaccgaaggggctgggactgggctgggactaggtttacncaatagtgtagtaggaaagtaaactcaacgtacgaccggcggtacctccgggtaggaaacggggcctacttaccgacctattaccaccgaagaaacgaactaaacgtaaccgaaacgtaaaccgacgggttataactacctaaccaaagtcggaacacggcctaggcgtagcgtacggaacggaccgacgtcgttagtacgttaccgttcgacggtcgaccgtaaggaggtttaggttaacgggtaggggttaccgttatttacgtttacgtaccggtttacgttaaccccg

SEQ ID NO: 328059 - DNA, 557 bp, Homo sapiens
  misc_feature: GZ8MTXP02GEMG2.45.74.G08.1.454.CMB.2.raw
  modified_base (345)..(345): a, c, t, g, unknown or other
  misc_feature (345)..(345): n is a, c, g, or t
  modified_base (433)..(433): a, c, t, g, unknown or other
  misc_feature (433)..(433): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggcgtcgctgagctctctgtatggttctggattcaccttcaagagtcatggactgcacgtgggtcccgccacgggcccccaggccaaggggctgggactgggctgggcagttacgcatngatggaaataatcatacgtacgcggactccgtagaacgggtcctattccaccgatcctaccagaacgacaacttacaaagacacggtntactcaccaatgacagcctagcgagcgtagaacggacacggtctggtcgttaacttcgtagtcgaccgaggagttaggtttgggtaggggtcggtatttagtttacgacgttacggttaacccg

SEQ ID NO: 328060 - DNA, 620 bp, Homo sapiens
  misc_feature: GZ8MTXP02G7SWB.45.74.G08.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
tcagacgcgatcgacacgaccggtgctcgatttagtagctctatcaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggagcgtggtccaggccgtgggcgtcgctgagctctctgtatgtctgatcacctnaagngtcatggactgctacgtcgggtccnccgacggcccccgaggccgaaaggggctggacgtgggctggctaggttaccgacatagtagagtagaaagtaatcaatacgtacgcggtacctaccggtaggaaacggggcctagttacactacactcgtaccgagtaacgtaactaaacttacccgaaagaaaccgtacggttaagtaaccttacctaaacccgtaaagtccggtaacacgtacccgagaccggagtaccgaggaacggaccgtacgtcgtgttacgtacgttccgtgacgaccgagtaaggtgtttacggagggtcgtaagtttcgtttacgtacgtttacccgg

SEQ ID NO: 328061 - DNA, 664 bp, Homo sapiens
  misc_feature: GZ8MTXP02FRT8C.45.74.G08.1.454.CMB.2.raw
  modified_base (190)..(190): a, c, t, g, unknown or other
  misc_feature (190)..(190): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (604)..(604): a, c, t, g, unknown or other
  misc_feature (604)..(604): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagcgtgggtggaggtcggggggagcgtggtccaggccgtgggcggtcgctgagctctctgtatggttcnggattcacttnaagagtcagtggactgctacgtcgggtcccnccacgggccccaggcgaaggggctgggactgggctgggactagtacgnatagtgagaggaaataancaagtacgacggcggtactaccggtaggaacgggcctaattccgacctacgttccgaccgaagtaacgaaactaacgttacccgaaaaggtaaccgtaacggttacttaaacctaccgtaaaccgaaaacggttcggaaccgtacggaccccgttagaccgggaacgtcggtaagggaacgggtaccgtacgggtcttacggttcgttaaccgtttcgaggttacgaccgtaaggnggtttaggttaagggtacgggttacggtatttggtttacgacgtttaccggttaaacccg

SEQ ID NO: 328062 - DNA, 601 bp, Homo sapiens
  misc_feature: GZ8MTXP02H0HK3.45.74.G08.1.454.CMB.2.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (444)..(444): a, c, t, g, unknown or other
  misc_feature (444)..(444): n is a, c, g, or t
  modified_base (500)..(500): a, c, t, g, unknown or other
  misc_feature (500)..(500): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagtcttggggttttcctcgttgcttcttttaagaggtgtccagtgtcaggtgcagctgggtgggaggtcggggggagcggtggtccagccgtggggcgtcgctgagctctcgtgtataggttctggattcacttcaaagtgtcatggactgcacgtcggccnccgacggccccaggcgaagggctggactggctggactgttaccntatagtgataggaaacgtaatcgtaatcgtacgcgaccttccggagacgggctattccacgatcacgagacgaactaactacgaaagacgtacggttnaactacctaccaaagtcggactcggacctggacgagcgtagacggtacgacggttntcgtacgttctcgtcggcgacgtaggtaacggtttaggttaacggggttaacgggttaaggttacgtttacggtttaccgttaacgtttacccggtaaccg

SEQ ID NO: 328063 - DNA, 624 bp, Homo sapiens
  misc_feature: GZ8MTXP02G4HAA.45.74.G08.1.454.CMB.2.raw
  modified_base (188)..(188): a, c, t, g, unknown or other
  misc_feature (188)..(188): n is a, c, g, or t
  modified_base (276)..(276): a, c, t, g, unknown or other
  misc_feature (276)..(276): n is a, c, g, or t
  modified_base (560)..(560): a, c, t, g, unknown or other
  misc_feature (560)..(560): n is a, c, g, or t
tcagacgcgatcgacacgaccggtgctcgatttagtagctctatcaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggaggtcggggggagcgtgggtccagccgtggggcggtcgctgagactctcctgtataggttctggattcaccttcaagngtcatggactgcacgtgggtccgccacgggcccccaggccgaaggggctgggactgggcctggactaggttacgtcagtacgtgagtaggaaacgtaaatacataccgtacgcggtaacgtccgtagggaacggggtacctattccgaaccctagtcctaccgaagtacgaactactaccgaaagaacgacgtagtactactaccaaagtcgaacacgacctcgaccgagtccgtaggacggacgacggtctacggtacgttacttcgtagtcgaccgtaaggngttaggtttgggtaaacggggtcgggttactttaggtttactacggtttaccggtttaaccccg

SEQ ID NO: 328064 - DNA, 513 bp, Homo sapiens
  misc_feature: GZ8MTXP01BXPTJ.15.1.A01.1.454.CMB.2.raw
  modified_base (364)..(364): a, c, t, g, unknown or other
  misc_feature (364)..(364): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaatcatgatttatgaggccactaagcgaccctcagggctttctaatcgctttctctggctccaagtctggcaacacggcctccctgacaatctcctgggctccaggctgacgcgaggctaattntactgctgctcatatgaaggttataacactatactattcggcgagggaccaaggctgaccgtcctgcgtcagcccaaggctgcccctcggtcacttctcgttcccaccctccttccgttcgttgaactgaagcgggcttgggcaagggc

SEQ ID NO: 328065 - DNA, 423 bp, Homo sapiens
  misc_feature: GZ8MTXP01EQ4TP.15.1.A01.1.454.CMB.2.raw
  modified_base (420)..(423): a, c, t, g, unknown or other
  misc_feature (420)..(423): n is a, c, g, or t
tcagtctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttccccctggcacccctcctccaagacgcacctctgggggcacagccggccctgggctgcctggtcaaggactacttccgctacgtagactgagcgggctggcaaggcgcatagnnnn

SEQ ID NO: 328066 - DNA, 501 bp, Homo sapiens
  misc_feature: GZ8MTXP01D7VIG.15.1.A01.1.454.CMB.2.raw
  modified_base (227)..(227): a, c, t, g, unknown or other
  misc_feature (227)..(227): n is a, c, g, or t
  modified_base (357)..(357): a, c, t, g, unknown or other
  misc_feature (357)..(357): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnagacgccccaaatcatgatttatgaggccactaagcgaccctcagggctttctaatcgcttctctggctccaagtctggcaacacggcctccctgacatctctggctccagctgacgcgaggctaaattnttactgctgctcatatgaagttataaacactatactattcggcggagggaccaaggctgaccgtctgcgtcagcccaaggctcgcccctcggtctcttctcgttccccgccctccttcgcttacgnactgagcggntggcaagg

SEQ ID NO: 328067 - DNA, 522 bp, Homo sapiens
  misc_feature: GZ8MTXP01D9NKE.15.1.A01.1.454.CMB.2.raw
  modified_base (370)..(370): a, c, t, g, unknown or other
  misc_feature (370)..(370): n is a, c, g, or t
  modified_base (501)..(501): a, c, t, g, unknown or other
  misc_feature (501)..(501): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctctggtaccaacaccacccggcagagccccaaactcatgatttatgaggccacaaagcgaccctcagggctttctaatcgcttctctggctccaagtctggcaacacggcctcctgacaatctcctgggctcaggctgacgcgagctaattatactgctgctnatatgaaggttataaacactaatactattcggcgaagggaccaaaggctgaccgtcctgcgtcagaccccaaggcctcggccccctgggtcctaacttcttcgttccccgccctccttcgcttaccgtaanactgagcggcgtcggcgaagg

SEQ ID NO: 328068 - DNA, 509 bp, Homo sapiens
  misc_feature: GZ8MTXP01D2BX4.15.1.A01.1.454.CMB.2.raw
  modified_base (294)..(294): a, c, t, g, unknown or other
  misc_feature (294)..(294): n is a, c, g, or t
  modified_base (505)..(509): a, c, t, g, unknown or other
  misc_feature (505)..(509): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattctaatatgaacagcctgagagccgaatgacacggctgtgtatttcngtgcgagagacggtataatagttactggttgcagtcggggccagggaccctggtcaatcgtctcgtcacgcctccacgaagggccccatcgtcctccccgtgccaccctcctccaagacgcacctcgtggggcacgacgcggccctgggctgcctggtacaaggtctacttccgctaacgtgactgagcgggcttggcaaggcgcaatagnnnnn

SEQ ID NO: 328069 - DNA, 526 bp, Homo sapiens
  misc_feature: GZ8MTXP01CLO10.15.1.A01.1.454.CMB.2.raw
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgccccaaatcatgatttatgaggccactaagcgaccctcagggctttctaatcgctttctctggctccaagtctggcaacacggcctccctgacaatctcctgggctcaggctgacgcgaggctaaattatactgctgctcatatgaaagttataacacttatactagttcgacggaggaccaaggctagaccgtcctagcgtcgagacccgaacgtcctcgccccctcggtccacgttctcgttccccgccctccncgcttacgtaanactggacgcgggctcggcgaacgg

SEQ ID NO: 328070 - DNA, 519 bp, Homo sapiens
  misc_feature: GZ8MTXP01EVPGZ.15.1.A01.1.454.CMB.2.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaatcatgattangagccacaagcgaccctnagggctttctaatcgcttctctggctccaagtctggcaacacggcctcctgacaatctcctgggctccgaggctaagacgaacgagacttaattattactgctgctcatatgaagttataacattatactagttcggaggacgggaccaaggctgaccgtcngcgtcacgacccaaggtcctccgcccctcggtctacttctccttcccctaccctccncgcttacgtnactgnggcgcgtggcgaagg

SEQ ID NO: 328071 - DNA, 514 bp, Homo sapiens
  misc_feature: GZ8MTXP01AJX8C.15.1.A01.1.454.CMB.2.raw
  modified_base (227)..(227): a, c, t, g, unknown or other
  misc_feature (227)..(227): n is a, c, g, or t
  modified_base (410)..(410): a, c, t, g, unknown or other
  misc_feature (410)..(410): n is a, c, g, or t
  modified_base (483)..(483): a, c, t, g, unknown or other
  misc_feature (483)..(483): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnagagccccaaatcatgatttatgaggccactaagcgaccctcagggctttctaatcgcttctctggctccaagtctggcaacacggcctccctgacaatctcctgggctccaggctagacgcgaggaccttaaattacttactggctgctcatatgaaagttataaacactatactattcggnggagggaccaaggctgaccgtcctgcgtcacgcccaaggtctcgcccctcggcacttctcgttccgccctccncgcttacgtgactgacgcgggctggcaacgg

SEQ ID NO: 328072 - DNA, 573 bp, Homo sapiens
  misc_feature: GZ8MTXP01D1EDS.15.1.A01.1.454.CMB.2.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
  modified_base (374)..(374): a, c, t, g, unknown or other
  misc_feature (374)..(374): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnagacgaccccaaatcatgattatgagcanaagcgacctgaggtctttcaatcgctttcgtctcggctcaagtctaggacaacacggcctccctgacaatctcgtgggctcgaggctagacgaagaggactaaattatactgctgctnatatagaagttataaacactaatactagtcggaggaggaccaaggcgtgaccgtccgtgcgcacgacccgaacgccgtccgcccccgtcggtccctaaccttcccttccggtttcccccccgtccccgttcccgttacccgttaccgttacggtaacgacgtcggacgggccgggttacgtaacgggaacggtaacggg

SEQ ID NO: 328073 - DNA, 519 bp, Homo sapiens
  misc_feature: GZ8MTXP01BINCA.15.1.A01.1.454.CMB.2.raw
  modified_base (389)..(389): a, c, t, g, unknown or other
  misc_feature (389)..(389): n is a, c, g, or t
  modified_base (496)..(496): a, c, t, g, unknown or other
  misc_feature (496)..(496): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacccggcagacgccccaaactcatgatttatgaggccactaagcgaccctcagggctttctaatcgcttctctggctccaagtctggcaacacggcctccctgacaatctcctgggctccgaggctgacgcgagctaaattatactgctgctcatatgaaagttanaacactatactattcggcgagggaccaaggctgaccgtctgcgtcagccccaaggcctcgccccctcggtcacttctcgttccccgccctccttacgcttacgtaanactgacgcgggctcggcgaacgg

SEQ ID NO: 328074 - DNA, 513 bp, Homo sapiens
  misc_feature: GZ8MTXP01AP5G9.15.1.A01.1.454.CMB.2.raw
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (464)..(464): a, c, t, g, unknown or other
  misc_feature (464)..(464): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctccaggctgacgcgaggctaattnttactgctgctnatatgaaggttataacactatactagttcggcggagggaccaaggctgaccgtcctgcgtcacgcccaaggcctcgccccctggtcncgttctcgttcccaccctccncgcttacgtgactgngcggctggcaagg

SEQ ID NO: 328075 - DNA, 535 bp, Homo sapiens
  misc_feature: GZ8MTXP01EJ8ZX.15.1.A01.1.454.CMB.2.raw
  modified_base (226)..(226): a, c, t, g, unknown or other
  misc_feature (226)..(226): n is a, c, g, or t
  modified_base (382)..(382): a, c, t, g, unknown or other
  misc_feature (382)..(382): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccacaccacccggnagacgcccccaaatcatgatttatgaggccacaagcgaccctcgagggtctttctaatcgcttctctggctccaagtctggcaacacggcctccctgacaatctcctgggctccgaggctagacgaacgaggaccttaaattattactgctgcctnatatagtaaaggttataaactacttaatactagttcggacggaggaccaaggctcgaccgtcctgcgtcacgacccaagtcctccgccccctcggtcacttctccgttccccaccctccttcgcttacgtgactgacgcgggctggcgaacgg

SEQ ID NO: 328076 - DNA, 543 bp, Homo sapiens
  misc_feature: GZ8MTXP01B78DI.15.1.A01.1.454.CMB.2.raw
  modified_base (252)..(252): a, c, t, g, unknown or other
  misc_feature (252)..(252): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccacccggcagacgcccccaaatcatgatttangaggccactaagcgaccctcaggctttcaatcgcttctctggctccaagtctggcaacgacggcctccctgacatctcctgggctcaggctgacgcgagctaattatactgctgctcatatagtaagttaataaacactaatactagttcgggcgggaacggaccaaggctcgaccgtcctgccgtcgacgacccgaacggtcctccggccccctcggtccaccgttctcccgttccccacccctccttccgttcttacgtaacgacgtgacggcgggctcggcgaacggg

SEQ ID NO: 328077 - DNA, 573 bp, Homo sapiens
  misc_feature: GZ8MTXP01DN8DI.15.1.A01.1.454.CMB.2.raw
  modified_base (369)..(369): a, c, t, g, unknown or other
  misc_feature (369)..(369): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgcttattttaaaaggtgtcagtgtgaggtgcagctggtggagtcgtgggggaggcttggtccgaggcccgggggggtcctgagactctcatgtgcaggctctggattcagcgtcaaggaatagttaacagtgaggttcgggtccgccgaggcctccgaggggcagggggctagagtggctctcaatgattacacaagtcggggacgtggaccanataacacgcagattccgagaagggcaagattcacatctaccagagacaagtttaggaacgaaacaccgtgtaatttacttaaagtatagaaacagacctagagagaccgatacgacncgnttgtgttatttcgttggtcgacggaggaaggttacgggtaattaagttaagttacgttagggtttacggaaccgttcggtcggg

SEQ ID NO: 328078 - DNA, 516 bp, Homo sapiens
  misc_feature: GZ8MTXP01AEGAV.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttctctggctccaagtctggcaacacggcctcctgacatctctgggctccagctgacgcgaggctaattatactgctgctcatatgaaggttataacactatactattcggcggaggacaaggcttgaccgtcctgccgtcacgacccaaggtcctcgccccctgggtccacttctcgttcccgccctccttcgcttacgtgactgagcgggctggcgaacgg

SEQ ID NO: 328079 - DNA, 545 bp, Homo sapiens
  misc_feature: GZ8MTXP01ETTGD.15.1.A01.1.454.CMB.2.raw
  modified_base (259)..(259): a, c, t, g, unknown or other
  misc_feature (259)..(259): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcagacgcccccaaatcatgattatgaggccanaagcgaccctcgagggtctttctaatcgcttctctggctccaagtctggcaacaccggcctccctgacaatctcctgggctcgagctagacgcgaggctaattattacngctgctnatatgaagttataanactatactagttcggcggaggacaaggctcgaccgtcctgcgtcgacgcccgaaggtcctccgccccctcggtcctaccttccgtccgtttccccgccccttcccgttccgccttaccggttaagactaacggcggcggggctcgggcgaacggg

SEQ ID NO: 328080 - DNA, 537 bp, Homo sapiens
  misc_feature: GZ8MTXP01CPZXR.15.1.A01.1.454.CMB.2.raw
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggggttatcacttgtctctggtaccaacaccacccggcagacgccccaaatcatgattatgagcacaagcgaccctcaggctttcaatcgcttctctggctccaagtctggcaacacggcctccctgacaatctctgggctccaggctgacgcgaggctaaattatacngctgctanatatagtaagttaataactactatactagtcggacggaggacaaggctcgaccgtcgtgcgtcgacgacccgacggtcctccgccccgtcggtcctccgttccgttccgttccccgcccttcccgttccgccttacgtaagacgtggacggcgggcgtcgggaacgaacggg

SEQ ID NO: 328081 - DNA, 535 bp, Homo sapiens
  misc_feature: GZ8MTXP01AKK4X.15.1.A01.1.454.CMB.2.raw
  modified_base (257)..(257): a, c, t, g, unknown or other
  misc_feature (257)..(257): n is a, c, g, or t
  modified_base (510)..(510): a, c, t, g, unknown or other
  misc_feature (510)..(510): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttangaggccacaagcgaccctcagggctttcaatcgcttctctggctccaagtctggcaacacggcctcctgacatctcctggctcaggctgacgaacgagctaaattatactgctgctcatatagaagttataacactatactagttcggacggacggacaagggctcggtacccgtccgttgccgtcacgacccgaaggtccctccgccccctggtccaccttctccgttccccaccctccttcgccttacgtnacgtgacggtcgggctggccgaagg

SEQ ID NO: 328082 - DNA, 509 bp, Homo sapiens
  misc_feature: GZ8MTXP01DZ0EG.15.1.A01.1.454.CMB.2.raw
  modified_base (372)..(372): a, c, t, g, unknown or other
  misc_feature (372)..(372): n is a, c, g, or t
  modified_base (494)..(494): a, c, t, g, unknown or other
  misc_feature (494)..(494): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcagacgcccccaaatcatgatttatgaggccactaaagcgaccctcagggctttctaatcgcttctctggctccaagtctggcaacacggcctcctgacaatctcctgggctccaggctgacgcgaggctaattatactgctgctnatatgaaagttataaacactatactaagttcggcggtaggaccaaggctgaccgtctgcgtcagcccaaggcctcgcccctggtcacttctcgttcccaccctccttcgcttacgtgactgngcgggctggcgaagg

SEQ ID NO: 328083 - DNA, 592 bp, Homo sapiens
  misc_feature: GZ8MTXP01C9U0V.15.1.A01.1.454.CMB.2.raw
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattggagaacaccgtgattctaatatgaacagcctgagagccgatgacaggctgtgtatttctgtgcgagagacggtataatagttactggtttgccagtcggggccagggaaccctggtcaattcgtctcgtctaggccctccgaaccgaaacggggccccacttccggtccttcccccgtcggccctacccctccctacccgaacgacgaccaccgtcgtcgggggccacggacggccggccccgtcgggcctcgccgtcggtacgaaacggtacctaccgttcccgcgtaacgttacggaaccgtggacggccgggggccgttgggccgaaacgggcggacctaacgtaaggngnngngng

SEQ ID NO: 328084 - DNA, 581 bp, Homo sapiens
  misc_feature: GZ8MTXP01D2X6O.15.1.A01.1.454.CMB.2.raw
  modified_base (226)..(226): a, c, t, g, unknown or other
  misc_feature (226)..(226): n is a, c, g, or t
  modified_base (368)..(368): a, c, t, g, unknown or other
  misc_feature (368)..(368): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctgtaccaacaccacccggnagagccccaaatcatgatttatgaggccactaaagcgaccctcaagggctttctaatcgcttctctggctccaagtctggcaacacggcctccctgacaatctctgggctccaggctagacgcgagctaaattatactgctnctctatatagtaagttaataaactaactaataactacgttacggacgggaacgggaaccgaacggacgtcgtaccgtaccgtcgtcgtacgacgaccgaacgtccgtccgtccccgtccgtcctaccttccttcccgttaccccgtacccctcccttaccgttccgttaacgtaacgtacgtaacggacgggcgggcggtcggaacggaacgg

SEQ ID NO: 328085 - DNA, 572 bp, Homo sapiens
  misc_feature: GZ8MTXP01BM0HV.15.1.A01.1.454.CMB.2.raw
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcacgacgacccccaaactcatgtatttatgaggccacaaacgccgaccctcagggtctttctaatcgtcttctctggctccaagtctggacaaccgaccggtcctcctagactaatctccgnggctcgaggctagacgngagcttaaattntactgctgctcatatagtaacgttaataacactatactagttcggacggaggacaggctcgtaccgtcgtcgccgtacacggacccaacgtcccgtccgtcccccgtcggtcctaccgttcttcccttcccctaccctcccttccgttcttacgtaacgtacgtcggaggccgggcgtcgggcgaacggg

SEQ ID NO: 328086 - DNA, 574 bp, Homo sapiens
  misc_feature: GZ8MTXP01BTF7B.15.1.A01.1.454.CMB.2.raw
  modified_base (568)..(570): a, c, t, g, unknown or other
  misc_feature (568)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattggagaacaccgtgattctaatatgaacagcctgagagccgatgacacggctgtgtatttctgtgcgagagacggtataatagttactggttgcacgtcggggccagggaccctggtcaatcgtctcgtcacgccctccaccgaacgggccccactccgtccttcccccgtcggcccaccctccctaccaacgacgccacccgtcgtcgggggaccaccgggacggccggcccgtcgggccgtcggcccgttggtaccgaaacggtacctaccgttcccgccgttaaccggtaagaccgtcggacggccgggcgttcgggcaagggccgcgaagtagnnngngn

SEQ ID NO: 328087 - DNA, 505 bp, Homo sapiens
  misc_feature: GZ8MTXP01BE5LQ.15.1.A01.1.454.CMB.2.raw
  modified_base (317)..(317): a, c, t, g, unknown or other
  misc_feature (317)..(317): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgacccctcagggctttcaatcgcttctctggctccaagtctggcaacncggcctccctgacaatctcctgggctccaggctgacgcgaggctaaattattactgctgctcatatgaagttataacactatactattcggcggaggaccaggctgaccgtctgcgtcagcccaaggctcgccccctggtcacttctcgttcccacctcttcgcttacgnctgngcggctggcgaagg

SEQ ID NO: 328088 - DNA, 557 bp, Homo sapiens
  misc_feature: GZ8MTXP01B1HC6.15.1.A01.1.454.CMB.2.raw
  modified_base (379)..(379): a, c, t, g, unknown or other
  misc_feature (379)..(379): n is a, c, g, or t
  modified_base (473)..(473): a, c, t, g, unknown or other
  misc_feature (473)..(473): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggagcttggtccaggccgggggggtccctgagactctcatgtgcaggctctggattcagcgtcaggatagttacatgagttgggtccgccaggctccgaggggcagggggctagagtggctctcaatgatttacacggagtcggggacggtggaccacataacacgcagattccgngaagggcagattcacatctcagagacatttggagaacaccgtagatttacttaagtatagaacaggcctgacgacgaccgatcgacgaccggtntggttgttatttcgttggtgcggttaaggacggttacgggttaataagtaagttacgtgggtttacggccgttaacgtcggggg

SEQ ID NO: 328089 - DNA, 504 bp, Homo sapiens
  misc_feature: GZ8MTXP01DXSEW.15.1.A01.1.454.CMB.2.raw
  modified_base (224)..(224): a, c, t, g, unknown or other
  misc_feature (224)..(224): n is a, c, g, or t
  modified_base (398)..(398): a, c, t, g, unknown or other
  misc_feature (398)..(398): n is a, c, g, or t
  modified_base (488)..(488): a, c, t, g, unknown or other
  misc_feature (488)..(488): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctgtacacaccacccggnagagccccaaatcatgatttatgaggccactaagcgaccctcagggctttctaatcgcttctctggctccaagtctggcaacacggcctcctgacaatctctgggctccaggctgacgcgaggctaaattattactgctgctcatatgaaggttataacactatactattcggngagggaccaaggctgaccgtctgcgtcagacccaaggcctcgccccctggtccacttctcgttcccgccctccttcgcttacgtgactgngcgggctggcgaaggg

SEQ ID NO: 328090 - DNA, 557 bp, Homo sapiens
  misc_feature: GZ8MTXP01BBCFK.15.1.A01.1.454.CMB.2.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (324)..(324): a, c, t, g, unknown or other
  misc_feature (324)..(324): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggnagacgccccaaatcatgattangaggccactaagcgaccctcgaggtctttctaatcgcttctctcggctccaagtctggacaacgacggcctccngacatctctggctcgagctagacgcgagtactaaattatactgctgctacatatagtaagttataacactatactagttcggacggtaaggaccaaggcgtcgaccgtcgtacgcgtcgacgcccgaaggtcctccgtccccctcggtcctaccgttccgttcccgttccccgccccttccgttccgccttacggtaacgtaccgtggacggcgggcgtcggaacgtaacggg

SEQ ID NO: 328091 - DNA, 512 bp, Homo sapiens
  misc_feature: GZ8MTXP01DZW4M.15.1.A01.1.454.CMB.2.raw
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (481)..(481): a, c, t, g, unknown or other
  misc_feature (481)..(481): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcagacgcccccaaatcatgatttatgaggccactaagcgaccctcagggctttctaatcgcttctctggctccaagtctggcaacacggcctcctgacaatctcctgggctcaggctgacgcgagctaaattatacngctnctcatatgaaagttataaacactaatactagttcggacggagggaccaaggctgaccgtctgcgtcacgaccccgaagtcctcgcccctcggcacttctcgttcccaccctcncgcttacgtgactgagcgggctcggcgaagg

SEQ ID NO: 328092 - DNA, 554 bp, Homo sapiens
  misc_feature: GZ8MTXP01D7E8F.15.1.A01.1.454.CMB.2.raw
  modified_base (492)..(492): a, c, t, g, unknown or other
  misc_feature (492)..(492): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccaggccggggggtccctgagactctcatgtgcaggctcgtggattcagcgtcaggtaatagttacagtgagttggtccgcaggctccgagggcaggggctaggagtggctctacaatgtatttacgaccgagtcgggggacggtagggaccacataaacctacgcgagattcccggtagaagggcagattcacatctccagagaactaagtttggagaaccaccgtatattacttaatatagaaaccagcctagagacgaccgagtgactaccggntgtgttattcgttgtgcgagagacgggtaataagtgttacgtggttcgcgttgtaaccgggg

SEQ ID NO: 328093 - DNA, 533 bp, Homo sapiens
  misc_feature: GZ8MTXP01EWDIB.15.1.A01.1.454.CMB.2.raw
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttangaggccacaagcgaccctnagggctttctaatcgcttctctggctccagtctggcaacacggcctcctgacaatctccgngggctccaggctagacgaacgaggctaaattacttactgctgctcatatgaagttataaacacttatactagttcggnggaggaccaaggctgacccgtctgccgtcacgcccaaggtcctcgccccctcggtaacctccttcgtcgttccccgcccctccnccgcttacgtaagactggngcgggctcgggcgaacgg

SEQ ID NO: 328094 - DNA, 544 bp, Homo sapiens
  misc_feature: GZ8MTXP01D1239.15.1.A01.1.454.CMB.2.raw
  modified_base (518)..(518): a, c, t, g, unknown or other
  misc_feature (518)..(518): n is a, c, g, or t
  modified_base (540)..(544): a, c, t, g, unknown or other
  misc_feature (540)..(544): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgaatgacacggctgtgtatttctgtgcgagagacggtataatagttactggttgcacgtcgggccagggaccctggtcaatcgtctcgtcacgcctccgaccgaagggcccactccggtccttcccccgtggccacccctcctccaacgacgccgacctcgtgggggacacggacgccggcccgtgggcgtcgccgtggtacacgggtacctacgttccgctaacgttgaccgtgacggcgggtcncggcaaacgggcgacaagtagnnnnn

SEQ ID NO: 328095 - DNA, 543 bp, Homo sapiens
  misc_feature: GZ8MTXP01A5DME.15.1.A01.1.454.CMB.2.raw
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (539)..(543): a, c, t, g, unknown or other
  misc_feature (539)..(543): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttgganaacacgtgattctaatatgaacagcctgagagccgatgacacggctgtgtatttcngtgcgagagacggtataatgttactggttgcacgtcggggccagggaccctggtcaatcgtctcgtcagccctccacgaagggcccactcgtctccccncgccaccctcctccaagacncaccncgtggggccacggacgccggcccgtcgggcctcggcccgtggtaccgaacggtcctaaccgttcccgcgtaacgtacgaccgtggaacggcgggtcgttcgggacgaacgggcggcaagaggnnnnn

SEQ ID NO: 328096 - DNA, 561 bp, Homo sapiens
  misc_feature: GZ8MTXP01DB1LW.15.1.A01.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccgtgaagggcagattcaccatctcagagacaattgganaacaccgtgattcttaaanatgaacagcctgagagccgatgacacggctgtntatttcngtgcgagagacggtataaatgttactggttcgcagtcggggccagggaccctggtcaagtcgtcncgtcagccctacacgaacgggcccatccgtcctccccgtcgccaccctctaccaacgacgccacctcgcggggccacggacgccggcctcgggctcgccgtggtaccaacggtaccttaccgttcccgcgttaaccgtacggttaccgtcgggacggtccgggcgttcgggcgaacgggccggactaagtaggngnngngng

SEQ ID NO: 328097 - DNA, 608 bp, Homo sapiens
  misc_feature: GZ8MTXP01B2ZMU.15.1.A01.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaaccaacaccacccggnagacgaccccaaatcatgatttangaggcacaagcgacctcaaggctttacaatcnctttctcgtcggctaccaaagtctggacaaaccacggccttcccngaccaatcctcggnggcncgagcaagaacgaagagtaattaattatacgntctntctactataagtaagtaaagttaaataaactaactaataacgtaacgttacgggacgggaacggaacgaacggtacgtacgtaccgtaccgtcgcgaccgacgacccgaacgtccgtcccgtccccgtcccgtcctaccgttccgttcccgttccccgtccccgtcccgttaccgttccgttaccgtaacgtacggtcggcggacgggcggtcggaacggaacgg

SEQ ID NO: 328098 - DNA, 517 bp, Homo sapiens
  misc_feature: GZ8MTXP01E2AHC.15.1.A01.1.454.CMB.2.raw
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacaccacccggnagacgcccccaaatcatgatttatgaggccactaagcgaccctnagggctttctaatcgctttctctggctccaagtctggcaacacggcctcctgacaatctcctgggctccaggctgacgcgaggctaaattattactgctgctcatatgaaggttataacactatactattcgtggaggacaaggctgaccgtctgcgtcacgccaaggtctcgcccctcggtctacttctcgttcccacctcccgcgttcgacgtctcggaacgcgggcttcgggcgaacggcg

SEQ ID NO: 328099 - DNA, 539 bp, Homo sapiens
  misc_feature: GZ8MTXP01C677J.15.1.A01.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggnagacgccccaaactcatgattangagcacaagcgaccctcgaggtctttctaatcgtcttctctggctccaagtctggcaacacggcctcctgacatctcngggctcagctagacgcgagacttaaattatactgctgctanatatagtaagttataactatatactagttcggcggaggaccaaggcgtacgaccgtccgtgccgtcgacgacccgaacggtcctccgcccccttcggtcctaccgttccttccgttcccctaccctccttcgcttacgtaagacgtggacggcgggcgtcggccgaagg

SEQ ID NO: 328100 - DNA, 569 bp, Homo sapiens
  misc_feature: GZ8MTXP01C6QBX.15.1.A01.1.454.CMB.2.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctctggtaccaacaccacccggcagagccccaaatcatgattatgaggcacaaancgaccctcagggctttctaaatcgcttctctggctccaaagtcngacaacacgcctccngacatctccngggctcagctagacgaacgagtacttaaattatactgctgctacaataagtagaaaggttaaactaaactaacttaataactacgttacgggacgggaagggaccaaggctcggaaccgtccgtgccgtcacgacccgaaggccgtcgccccctcggtaacctacttcgttccgttcccctacccctcccgttccgccgttaccgtaacgtacgtcgacggcgggcggtcggcgaacgg

SEQ ID NO: 328101 - DNA, 577 bp, Homo sapiens
  misc_feature: GZ8MTXP01ERQ0X.15.1.A01.1.454.CMB.2.raw
  modified_base (235)..(235): a, c, t, g, unknown or other
  misc_feature (235)..(235): n is a, c, g, or t
  modified_base (572)..(574): a, c, t, g, unknown or other
  misc_feature (572)..(574): n is a, c, g, or t
  modified_base (576)..(577): a, c, t, g, unknown or other
  misc_feature (576)..(577): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattgganaacaccgtgattcttaatatgaacagcctgagagccgatgacacggctgtgtatttctgtgcgagagacggtataatagttactggttgccagtcggggccagggaccctggtcaatcgtctcgtcacgccctaccaccgaacgggcccacgtccgttcccttcccccgtcggcccacccctccctaccaacgacgccacccgtcggtcgggggaccacggacggcccgggccccgtcggggcctcgcccgtacggtaccgaaacggtacctaaccgttcccgcgtaacggtaacgacgtcggacggccgggcgttcgggcgaacggcgacaagagnnngnn

SEQ ID NO: 328102 - DNA, 631 bp, Homo sapiens
  misc_feature: GZ8MTXP01EUJAR.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagccctgcctccgtgtctgggtctcctggacagtcgatcaccatctcctgcactgaaccagccagtgattgttgggactctactgtctcctacgtaccaaccacccgacccgacacgaccgaccccaaactctatagtattagtcgacgaccaacgaacgccgtaccgtcgtacggtctttactactccgtctttctcgtcgcctacacgtcgtacggaccaccgtacccggtccctacccgtacgacctacttccgttcccggtccgggtctaccggtacggtcgtaacggaaccggtaacgtacgtactttaattctactcgctcgtctactataagttaaggtaagttaactaactactaacttaacgtacggttacgggacgggacgccgacggctttccacgccctcgacggtcccaaggcccctaggccctggtcccctccggtccacgttcccgccgttcccgtcctcacgttccgacgtaacgcgtcgacggcggcggtcgcgcg

SEQ ID NO: 328103 - DNA, 554 bp, Homo sapiens
  misc_feature: GZ8MTXP01ENJ6B.15.1.A01.1.454.CMB.2.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcgtggtttctgttacgtatttaaaggtgtcagtgtgaggtgcagctggtggagtctgggggagcttggtccagccgggggggtccctgagactctcatgtgcaggctctggattcagcgtnaggaatagtanatgtgtggcncgngcncgaggcgaggntagngtgctcanatgtattacgacgaggtggggaccggcggacatactacgaacgacngtacgtcgaggaggcagtactacactatcacagagaactaagttggaacacgtacgtagtattactaatagtacgaacacgacgagagacgacgacgacgtacgacgtcgtgttgttgttgtgttggtacggtaggaggttaggttaagttaagttagttaacgttggttcggttacggtaacggttcgggtaacgg

SEQ ID NO: 328104 - DNA, 557 bp, Homo sapiens
  misc_feature: GZ8MTXP01EADSG.15.1.A01.1.454.CMB.2.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (449)..(449): a, c, t, g, unknown or other
  misc_feature (449)..(449): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggggttatcaccttgtctcctggtaccaacacccaccccggnacgacgccccaaatcatgatttangaggccacaagcgaccctgaggctttcaatcgcttcnctggctccaagtctggacaacaccggcctcctgaacaatctcgtcgggctccgaggctaggaacgcgaggtacttaaattattactgctgctcatatagtaaagttataactactatactagttcgggacggaggaccaaggtctgacccgtcngcgtcacgacccaggtcctaccgccccctcggtcctaccttctccgttccccaccccttccttcgccgttacgaacgacgtcgacggcgggcgtcgggaacgaacggg

SEQ ID NO: 328105 - DNA, 536 bp, Homo sapiens
  misc_feature: GZ8MTXP01BZ370.15.1.A01.1.454.CMB.2.raw
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggagcttggtccaggccggggggtccctgagactctcatgtgcaggctctggattcagcgtcaggaatagttacatgagttgggtccgcgaggctccgaggggcagggggctagagtggctctcaatgattacacgagtcggggacggtgggaccacataactacgcagtactccgtgaagggcagattcacatctccagagactaagtttggagaacaccgtagaatttacttaaatatagaacagcctagagagaccgatcgacacggctgtgttatttcngtgcgagngacgggttaatagttaagttactggtttcgccgttgtccgggg

SEQ ID NO: 328106 - DNA, 591 bp, Homo sapiens
  misc_feature: GZ8MTXP01ELTUF.15.1.A01.1.454.CMB.2.raw
  modified_base (377)..(377): a, c, t, g, unknown or other
  misc_feature (377)..(377): n is a, c, g, or t
  modified_base (513)..(513): a, c, t, g, unknown or other
  misc_feature (513)..(513): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggagcttggtccaggccggggggtcctgagactctcatgtgcaggctcgtggattcgagcgtcgaaggtaatagttacagttggaggttcgggtcccgccgaggcctccgaggggcagggggctaggagtggctctacaatgtatttacgacgagtcgggggacggtggaccanataactacgcgagtacgttccggagaagggcagtacttacactatctacagacgtaactaagtttaggaacgaacgtaccgtagtactttacttaaatagtagaacacgcctagacgagaccgagtcgacgacggntaagtgttatttcgttgtgcgagacggttacggtaattaagtaacgtttacgtcggttcggccgttcggtaaccgggg

SEQ ID NO: 328107 - DNA, 579 bp, Homo sapiens
  misc_feature: GZ8MTXP01DEABX.15.1.A01.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctgtaccaacaccacccgnacgacgccccaaactcatgatttangagcacaagcgacctnaggtctttctaatcgtctttctctggctccaagtctggacaacgacggcctcctgacatctcgtcgggctcgagctagacgcgagtacttaaattatacngtactgctacatatagtaagttaanaactactatacgtagttcggacggaacggaaccaaggcgtcgaccgtccgtgccgtacacgtacccgaacggtcctccggcccccgttcggtcctaccgttcctccgttccccgtccccgttccttccggttaccttaccggtaacgtaacgtcgggaacggccgggttacgtcgggaacgaacggg

SEQ ID NO: 328108 - DNA, 549 bp, Homo sapiens
  misc_feature: GZ8MTXP01C4XON.15.1.A01.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctggtaccaacaccacccggnacgacgaccccaaatcatgattangagcanaagcgacctgaggtctttcaatcgcttctctgctcaagtcnggacaacgccggcctcctagactatctccgtggctcgagctagacgaacgagtactaattatacngctgctacatatagaagttanaactactatactagtcggacggaacggaccaagggctacgaccgtcgtgcgtacgacgacccgaaggtcctccgccccttggtcctaaccgttccgttcccgttccccgtccctccgttccgttcttacgttaagacgtcggacggcgggcgtcggcgaacgg

SEQ ID NO: 328109 - DNA, 531 bp, Homo sapiens
  misc_feature: GZ8MTXP01BVGDF.15.1.A01.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (480)..(480): a, c, t, g, unknown or other
  misc_feature (480)..(480): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctgtaccaacaccacccggnagacgccccaaatcatgatttangaggcacaagcgaccctnaggctttctaatcgcttctctggctccaagtctggcaacacggcctcctgacaatctacctgggctcgagctagacgngagactaattactactgctnctnatanagtaagttaataacattatactatcggacggaggaccaggcgtgacccgtcgtagccgtcacgacccaaggtccctcgccccctcggtccacttctccggttccccnccctcccttcgttcttacggtaagactggaggcggacgtggaaccgaaggg

SEQ ID NO: 328110 - DNA, 527 bp, Homo sapiens
  misc_feature: GZ8MTXP01BXI0E.15.1.A01.1.454.CMB.2.raw
  modified_base (254)..(254): a, c, t, g, unknown or other
  misc_feature (254)..(254): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaatcatgatttangaggccacaagcgaccctcagggtctttctaatcgcttctctgctcagtctggcaacacggcctccctgacaatctcctgggctcgaggctagacgaacgaggctaaattatactgctgctnatanagtaagttataaacactatactagttcggacggaggaccaaggctgaccgtcctgcgtcgacgcccaaggtcctcgcccctcggtccacttctcgttccccaccctccttcgcttacgtaagacgtgacggcgggttctggcgaagg

SEQ ID NO: 328111 - DNA, 537 bp, Homo sapiens
  misc_feature: GZ8MTXP01B3S2R.15.1.A01.1.454.CMB.2.raw
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaatcatgatttangaggccacaagcgaccctnagggctttcaatcgcttctctggctccaagtctggcaacacggcctccctgacatctccgtgggctccgaggctagacgcgaggctaaattatactgctgctcatatagaaaggttaataaactactataactagttcgggacggaggggaacccaagggctacgaccgtccgtgccgtcacgcccgaaggcctcgccccctggtcacttctccgttcccgccctccttcgcttacgtaagctgcgcgggttcgtggcgaacgg

SEQ ID NO: 328112 - DNA, 536 bp, Homo sapiens
  misc_feature: GZ8MTXP01CI6F2.15.1.A01.1.454.CMB.2.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggcagacgccccaaatcatgatttangaggccactaagcgaccctnagggtctttctaatcgcttctctcggctccaagtctggacaacacggcctcctgacatctcctgggctcgagctagacgngagactaaattctacngctgctnatagtagtaagttaataacgtaactatactagttcggacggagggaccaaggggctagacccgtctgcgtcagcccgagtcctccgccctcggtctacttcgtccgttcccgcccctcgttccgccttaccgaagacgtcgaggcgggctcgggcgaacggg

SEQ ID NO: 328113 - DNA, 535 bp, Homo sapiens
  misc_feature: GZ8MTXP01AGGUE.15.1.A01.1.454.CMB.2.raw
  modified_base (471)..(471): a, c, t, g, unknown or other
  misc_feature (471)..(471): n is a, c, g, or t
  modified_base (517)..(517): a, c, t, g, unknown or other
  misc_feature (517)..(517): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccaccccggcagacgcccccaaactcatgatttatgaggccactaagcgaccctcagggtctttctaatcgctttctctggctccagtctggcaacacggcctcctgacaatctctgggctccaggctagacgaacgaggctaaattatactgctgctcatatgaagttataaacactatactagttcggacggagggaccaaggctgccgtcctgccgtcgacgcccaaggtcctccgccccctcggtccnccttcctccgttccccgccctcccttccgccttacgtaacgactgnggtcggctcggcgaacgg

SEQ ID NO: 328114 - DNA, 539 bp, Homo sapiens
  misc_feature: GZ8MTXP01B904Z.15.1.A01.1.454.CMB.2.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (330)..(330): a, c, t, g, unknown or other
  misc_feature (330)..(330): n is a, c, g, or t
  modified_base (360)..(360): a, c, t, g, unknown or other
  misc_feature (360)..(360): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccacccggcagacgcccccaaatcatgatttangagccacaagcgaccctnaggctttcaatcgcttctctgctccaagtctggacaacacggcctccctgacaatctccnggctcaggctgacgcgagctaaattatacngctgctcatatgaaaggttaataactactatactattcgggagagggaccaaggctacgaccgtccgtgccgtcgacgcccgaagggtcctccggccccctcgggttccctacttccttccgttccccgaccctcccttcggcttacggtaagacgtgacggcggttctcgggcgaagg

SEQ ID NO: 328115 - DNA, 593 bp, Homo sapiens
  misc_feature: GZ8MTXP01D7S3Z.15.1.A01.1.454.CMB.2.raw
  modified_base (294)..(294): a, c, t, g, unknown or other
  misc_feature (294)..(294): n is a, c, g, or t
  modified_base (588)..(590): a, c, t, g, unknown or other
  misc_feature (588)..(590): n is a, c, g, or t
  modified_base (592)..(592): a, c, t, g, unknown or other
  misc_feature (592)..(592): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacacgtgattcttaaatatgaacagcctgagagccgatgacacggctgtgtatttcngtgcgagagacggtataatagttactggtttgccacgtcggggccagggaaccctggtcaacttcgtctcgtcacgccctacccacgaacggccccacgtccgtcccttcccccgtcggcccaccccgttccctaccgaacacggccacccgtcgtcgggggccaccggacggcccggcccgtcgggccgtcgcccgttagggtacctaaacgggtcccttaaccgttcccgccgttaacgtaacggacgtcggacgggccgggcgttcgggcgaaacgggccgcgtaagaggnnngng

SEQ ID NO: 328116 - DNA, 521 bp, Homo sapiens
  misc_feature: GZ8MTXP01BWKQH.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaactcatgatttatgaggccactaagcgaccctcagggctttcaatcgcttctctggctccaagtctggcaacacggcctccctgacaatctcctgggctccaggctgacgcgaggctaattattactgctgctcatatgaaggttataacacttatactattcggcggagggaccaagggctgaccgtctgcgtcagcccaaggcctcgccccctcggtcacttctcgttccccgcccctccttccgcttaccgtaagactgagcgggctggcgaacggg

SEQ ID NO: 328117 - DNA, 597 bp, Homo sapiens
  misc_feature: GZ8MTXP01DT8DU.15.1.A01.1.454.CMB.2.raw
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttgggtccgagggcccgggggggtccctggagactctcatgtgcaggctctggattcagcgtcaggaatagtacatgagttgggccncaggctcgagggcaggggctagngtgctctacaatgattacgacgtagtcgggggacgtggaccanataactacgcagtattccggtaggaagggcagattaccacactctaccagagaactaagtttagggaacgaacgtaccgtagtaactttacttaaatacgttagaacaggtcctagagacgtaccgagtgaccgacggtactgttgttatttcgttgtaggtacggaggacggttaacggggtaattaagttaacgtttacgtgggttacggtccgttaacgggtaaccgggg

SEQ ID NO: 328118 - DNA, 510 bp, Homo sapiens
  misc_feature: GZ8MTXP01DKW18.15.1.A01.1.454.CMB.2.raw
  modified_base (489)..(489): a, c, t, g, unknown or other
  misc_feature (489)..(489): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgaggccacaagcgaccctcagggctttctaatcgcttctctggctccaagtctggcaacacggcctcctgacaatctcctgggctccaggctgacgcgaggctaaattatactgctgctcatatgaagttataacactatactattcggcggagggaccaaggctgaccgtctgcgtcagcccaaggcctcgccccctggtccacttctcgttcccaccctccttcgcttacgtnactgagcgggctggcaacggg

SEQ ID NO: 328119 - DNA, 535 bp, Homo sapiens
  misc_feature: GZ8MTXP01BMMMF.15.1.A01.1.454.CMB.2.raw
  modified_base (226)..(226): a, c, t, g, unknown or other
  misc_feature (226)..(226): n is a, c, g, or t
  modified_base (495)..(495): a, c, t, g, unknown or other
  misc_feature (495)..(495): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccacaccacccggnacgacgccccaaatcatgatttatgaggccactaagcgaccctcgaggtctttctaatcgcttctctcggctccaagtctggcaacgacggcctcctgacatctctggctcgagctagacgcgagctaaattactactgctgctcatatagaagttactaacactatactattcggacggaagggaccaagggctacgaccgtcgtcgccgtcacgacccaacggtcctccgcccctcggtcctacttcctccgttccccacccttccncgttcttacgtaagacgtgacggtcggctcgggcaacggg

SEQ ID NO: 328120 - DNA, 607 bp, Homo sapiens
  misc_feature: GZ8MTXP01AP3LC.15.1.A01.1.454.CMB.2.raw
  modified_base (397)..(397): a, c, t, g, unknown or other
  misc_feature (397)..(397): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggagtcgtggggggaggcgttggtccgaggcccgggggggtccctgagactctcatgtgcgaggctcgtggattcagcgtcaggaatagttacatgagttgggtccgccgaggctccgagggcgagggggctaggagtggctctcaatgattacgaccgagtcggggacggtgggacccacataacctacgcagacttccggngagggcagacttcacatctacagagacgaagtttaggacgaacgacgtagtatttacttaaatactaggaaacacgtcctagacgtacgaccgtatcgaacgtcggtctggttggtttatttccgttggtcggacgaggttaacggttagggttaattaagttaacggtttaacgttgggtttacgggtaaccgttcgggtaaccggggg

SEQ ID NO: 328121 - DNA, 547 bp, Homo sapiens
  misc_feature: GZ8MTXP01B7ZTE.15.1.A01.1.454.CMB.2.raw
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagcttgggttttccttgttgctattttaaaaggtgtccagtgtgaggtgcagctggtggagtcgtgggggaggcttggtccgaggccgggggggtcctgagactctcatgtgcaggctctggattcagcgtcaggaatagttacatgagttgggtccgccaggctccgaggggcagggggctagagtggctcacaatgattacacgagtcggggacggtggaccanataactacgcagattccgagaaggcagatcacanctcagagactaagttganaacacgtanattacttaatatagaacagcctagagagaccgatcgacacggtntgttagttnttgnggtagagaggttaggttacggttaataagttaacgttacgtcgggttacgtaaccgttcggtcggg

SEQ ID NO: 328122 - DNA, 550 bp, Homo sapiens
  misc_feature: GZ8MTXP01C5DUK.15.1.A01.1.454.CMB.2.raw
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggggttatcacttgtctctggtaccaacaccaccccggcagacgcccccaaatcatgattatgagcanaagcaccctnaggctttcaatcgcttctctgctccaagtctggcaacacggcctccctgacaatctctgggctcgagctagacgaacgagactaaattatactgctgctnatatagtaaagttaataaacacttaataactagttacggacgggaacggggaaccaaagggcgtacggaacccgttccgtcggccgtcacggacccgaaaggccgttccgccccctcggtccaccttcctccgttcccctaccctccttcgccttacgtaagactgacgcgggctggcgaaggg

SEQ ID NO: 328123 - DNA, 517 bp, Homo sapiens
  misc_feature: GZ8MTXP01AYUW4.15.1.A01.1.454.CMB.2.raw
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaactcatgatttatgaggccacaagcgaccctcagggctttctaatcgcttctctggctccaagtctggcaacacggcctcctgacaatctcctgggctccgaggctgacgcgagctaaattatactgctgctcatatgaaggttataacactagtactattcggcggaggacaaggctggacctctgcgtcagcccaaggcctcgccccctcggtcctacttctcgttccccaccctcccttcgcttacgtaanactgacgngggcnggcgaaggg

SEQ ID NO: 328124 - DNA, 544 bp, Homo sapiens
  misc_feature: GZ8MTXP01DDVVK.15.1.A01.1.454.CMB.2.raw
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (536)..(536): a, c, t, g, unknown or other
  misc_feature (536)..(536): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggaggtcgtggggggaggcttggtccgaggcccgggggggtccctgagactctcagtgtgcgaggctcgtggattcagcgtcaggaatagttacatgagttgggtccgccgaggctccgagggcagggggctagagtggctntacaatgattacacgagtcggggacggtggaccanataactacgcagtagttccgagaagggcagacttcacatctcagagactaagttgaagaacacgtagtaatttcttaaatattagaaacagcctagagacgaccgatgacacggctgtnttatttcngtcgngagagnggtaatagtaagttcgtggttacgcgnggtccggg

SEQ ID NO: 328125 - DNA, 529 bp, Homo sapiens
  misc_feature: GZ8MTXP01DJTFZ.15.1.A01.1.454.CMB.2.raw
  modified_base (329)..(329): a, c, t, g, unknown or other
  misc_feature (329)..(329): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcagacgccccaaatcatgatttatgaggccactaagcgaccctcagggctttctaatcgcttctctggctccaagtctggcaacacggcctcctgacatctcngggctcagctagacgcgagtctaaattatactgctgctcatatgtaaggttaataaactactatactagttcggacggagggaccaaggcgtgacccgtccgtcgcgtcgacgcccgaacggtcctacgcccccttcggtcacttctcgttccccgtccctccttcgcttacgtaagactgcgcgggctcgggcgaacgg

SEQ ID NO: 328126 - DNA, 559 bp, Homo sapiens
  misc_feature: GZ8MTXP01EL4VX.15.1.A01.1.454.CMB.2.raw
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctcctggtaccaacaccacccggcacgacgacccccaaatcatgatttatgagccacaagcgaccctcgaggtctttctaatccgctttctctggctccaagtctggacaacgaccggcctcctgacaatctccgnggctcgagctagacgcgagtactaaattatactgctgctnatatagtaaagttaataaacactatacgtagttcgggacggaaggaccaaggcgtacgaccgtcgtgcgtcacgcccaaggtccctccgtcccctcggtaacctaccttcctcccgttaccccacccgttccttcgcgttacgtaagacgtgacgggcggacgtcggaacgaacgg

SEQ ID NO: 328127 - DNA, 564 bp, Homo sapiens
  misc_feature: GZ8MTXP01CQGEF.15.1.A01.1.454.CMB.2.raw
  modified_base (254)..(254): a, c, t, g, unknown or other
  misc_feature (254)..(254): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (450)..(450): a, c, t, g, unknown or other
  misc_feature (450)..(450): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctcctggtaccaacaccacccggcacgacgccccaaatcatgtattangacgccacaagccgaccctgaggtctttcaatcgtcttctctcggcctaccaagtctcggacaaaccgccggccctcctagaactatccgtccgtgggctcgaggctagacgngagtntaaattagtacngctgctnaatatagtaagttaataactaatatactagtcggacgaggaacaggtctacgtacctcngcgtcgcgacccgagtcctcccgtcccctaggtcctaccttccgttcccgttccccgtccctcccttcgcttaccggtaacacgtcggtacggcggttcgtcgggcgtaacggg

SEQ ID NO: 328128 - DNA, 543 bp, Homo sapiens
  misc_feature: GZ8MTXP01CKB4R.15.1.A01.1.454.CMB.2.raw
  modified_base (354)..(354): a, c, t, g, unknown or other
  misc_feature (354)..(354): n is a, c, g, or t
  modified_base (512)..(512): a, c, t, g, unknown or other
  misc_feature (512)..(512): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcacgacgcccccaaactcatgatttatgaggccacaagccgaccctcgagggtctttctaatcgcttctctggctcaagtctggacaacaccggcctcctgacatctccgtgggctcgagctagacgngagtactaattatactgctgctcatatgaaggttataactactatactagttcggacggagggaccaaggctgacctcgtgccgtcgacgcccgaaggtcctcgtccccgtcggtccaccgttcgtccgttccccaccccttcgttccgcttacggtnaccgtggacggcgggttctcgggcgaacggg

SEQ ID NO: 328129 - DNA, 529 bp, Homo sapiens
  misc_feature: GZ8MTXP01AXHEL.15.1.A01.1.454.CMB.2.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (407)..(407): a, c, t, g, unknown or other
  misc_feature (407)..(407): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcactgtctctggtaccaacaccacccggnagacgccccaaatcatgatttatgaggccactagcgaccctnagggtctttctaatcgcttctctggctccaagtctggccaacgacggccctcctagacaatctccgtgggctccaggctagacgcgagtctaaattatactgctgctcatatagtaagttataacatatactagttcgnggaggacaggctgaccgtcctgcgtcacgacccaggtcctcggtccccctggtcctacgttcctcgttccccaccctccgttccgcttacgtaagaccgtggacggcggccgtggcgaacgg

SEQ ID NO: 328130 - DNA, 518 bp, Homo sapiens
  misc_feature: GZ8MTXP01A2L31.15.1.A01.1.454.CMB.2.raw
  modified_base (373)..(373): a, c, t, g, unknown or other
  misc_feature (373)..(373): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcgagggctttctaatcgctttctctggctccaagtctggcaacacggcctccctgacaatctcctgggctccaggctgacgcgaggctaaattattacngctgctcatatgaagttataacactatactattcggcggagggaccaagggctgaccgtctgcgtcacgcccaaggctcgcccctcggtcacttctcgttcccgccctccncgcttaccgtaancgtgagcgggctgggcgaagg

SEQ ID NO: 328131 - DNA, 525 bp, Homo sapiens
  misc_feature: GZ8MTXP01C6UD3.15.1.A01.1.454.CMB.2.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
tcagtctacgtagccacgaccggtgctcgatttagacgtctcatcagggcctgggctctgctgctcctcactctcctcactcaggacacagggtcctgggcccagtctgccctgactcagtctgcctccgtgtctgggtctcctggacagtcgatcaccatctcctgcactggaaccagcagtgagttggttgggggttatcaccttgtctcctggtaccaacaccacccggcacgacgaccccaaatcatgattangagccacaagcgaccctnaggtctttctaatcgcttctctggctccaagtctggcaaccncggcctcctgacaatcctcgtcgggctccgagctacggacgcgagcttaaattcttactgctgctatatatagaagttataacattanacgtatcggacggagacaggctcgaccgttcngcgtcacgaccgagtcctccgcccgtggtcctcgttctccgttcccncctccttcgcttaggngtagcggnggcggttcnggcgaacg

SEQ ID NO: 328132 - DNA, 531 bp, Homo sapiens
  misc_feature: GZ8MTXP01CFRL6.15.1.A01.1.454.CMB.2.raw
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (527)..(531): a, c, t, g, unknown or other
  misc_feature (527)..(531): n is a, c, g, or t
tcagtctacgtagccacgaccggtgctcgatttagacgtctcatcaggggtcccgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattgagaacacgtgattcttaatatgaacagcctgagagccgatgacacggctgtgtatttcngtgcgaagaggacggtataagtagttacgtggttgccagtggggccccagggacctggtcatccgtctcgcacgccctccaccgaacgggcccagtccggtcccttcccccncggcccaccctcctaccaacgcnccaccgtcgtcggggcacgacgggccggcccgtggctcgccgtggcaacggcctacgtccgctacgtaacgacttgacggcggctggacgacggcgcagtgnnnnn

SEQ ID NO: 328133 - DNA, 532 bp, Homo sapiens
  misc_feature: GZ8MTXP01DEYC9.15.1.A01.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (366)..(366): a, c, t, g, unknown or other
  misc_feature (366)..(366): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnacgacgccccaaactcatgatttangaggccactaagcgaccctcagggtctttctaatcgtcttctctggctaccagtctggcaacacggcctcctgacatctcctgggctcgagctagacgcgagctaattattacngctgctcatatagaagttataactactatactagttcggacggagggaccaaggctcgaccgtctgcgtcacgacccgaacgtcctcgccccgtggtcctacttccgtccgttccccgcccttccgttcgcttaccgtaagactggacggcggacgtggcgaacgg

SEQ ID NO: 328134 - DNA, 556 bp, Homo sapiens
  misc_feature: GZ8MTXP01AEPM2.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgaggccacaagcgaccctcagggtctttcaatcgctttctctggctcaagtctggcaacacggcctcctgacaatctccgtgggctccgaggctgacgcgaggctaaattatactgctgctcatatgaagttataacactatactagttcggacggaggaccaagggctacggaccgtccgtgcgtacgacgacccaaggtccctccgtcccccgtcggtcctaacccgttcctccgttaccccgccccttcccgttccgttccttacgtaacgactcggacggcgggctcgggcgaacggg

SEQ ID NO: 328135 - DNA, 572 bp, Homo sapiens
  misc_feature: GZ8MTXP01CQ5DZ.15.1.A01.1.454.CMB.2.raw
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctcctggtaccaacaccacccgnagacgccccaaatcatgattangagcanagcacctnaggtctttcaatcgtcttctctggctaccaagtctggaccaacnccggccctccctagaacctaatccgtccgtgggctcgaggctaaggaaccgcgagtacttaaatttactacgtgctgctacatagtagtaaagttaataactacttaatactagttacggacggaacggaccaaggtctacgtaccgtcgtcgcgtccgacgacccgaaggtcctccgcccccgtcggtcctacttcgttcccgttcccgtcccctccgttccgcttacgtaacgacgtcggacggcggttctcggcgaacgg

SEQ ID NO: 328136 - DNA, 539 bp, Homo sapiens
  misc_feature: GZ8MTXP01B0GA3.15.1.A01.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (385)..(385): a, c, t, g, unknown or other
  misc_feature (385)..(385): n is a, c, g, or t
  modified_base (515)..(515): a, c, t, g, unknown or other
  misc_feature (515)..(515): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggtatcacttgtctctggtaccaacaccacccggnagacgaccccaaatcatgatttangaggccactaagcgaccctgaggtctttctaatcgtcttctctggctccaagtctggacaacgcggccctccctgacaatcctccgtcgggctccgagctagaacgcgagtcttaaattactactgctgtcctanatatagtaaagttataactactatactagttcggacggaaggaccaaggctcgaccgtcgtgccgtcacgacccgaaggtcctccgccccgtggtccacttcctccgttcccaccctcttcgcttacgtnacgtgacggcgggctggcgaacgg

SEQ ID NO: 328137 - DNA, 608 bp, Homo sapiens
  misc_feature: GZ8MTXP01EY5HV.15.1.A01.1.454.CMB.2.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (602)..(604): a, c, t, g, unknown or other
  misc_feature (602)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgngaagggcagattcaccatctcagagacattgganaacacgtgtattactaatatgaacagcngagagccatgacacggctgtgtatttcngtgcgaagagtacggtataagttagttacgtggtttcgcctacggtccggggaccgaacggggtacccctggtccaaagttccgtcgtccgtacaccgtccctacccgaccgaaacgggcccctacgtccgtccctccccgtcggccctacccctccctaccgaacgcgccaccgtcggtcgggggaccacggggacgtcccgggcccgtcgggccgtcgccgtcggtacaaccggtacttacccgtccgcgtaacgtacgttacgtcggacggccggggtcgttcgggccgaacgggccgacgaagtacggnnngngn

SEQ ID NO: 328138 - DNA, 558 bp, Homo sapiens
  misc_feature: GZ8MTXP01DCKZM.15.1.A01.1.454.CMB.2.raw
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
  modified_base (553)..(556): a, c, t, g, unknown or other
  misc_feature (553)..(556): n is a, c, g, or t
  modified_base (558)..(558): a, c, t, g, unknown or other
  misc_feature (558)..(558): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccanatactacgcagattccgtgaagggcagattcaccatctccagagacaattgganaacacgtgattacttaaatatgaacagcctgagagccgatgacacggntgtntatttcngtgcgagagacggtataatagttacgtgttgcacgtcgggccaggaccctggtcaattcgtcncgtcacgccctaccgaaccgaacgggcccacgtccgtcccttccccgtcgcccacccctccctaccaacgacgccaccgtcgtcggggacacggacggccggcccgtcgggcctcgccgtcgtaccgaacggtacctaccgtccgcgtaacgtacgacgtgacggtcgggcgttcggcgaacggcgacaagtagnnnngn

SEQ ID NO: 328139 - DNA, 535 bp, Homo sapiens
  misc_feature: GZ8MTXP01A2VBI.15.1.A01.1.454.CMB.2.raw
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (509)..(509): a, c, t, g, unknown or other
  misc_feature (509)..(509): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgccccaaactcatgatttangaggccacaagcgaccctcagggctttcaatcgcttctctggctcaagtctggcaacaccggcctcctagacaatctccgtgggctccgaggctagacgcgaggtcctaaattntactgctgctnatagtgtaagttataaacactatactagttcgggacggagggaccaaggctgacccgtctgccgtcacgacccgaaggtcctccgccccgtcggtcacttcctccgttcccgccctcttcggcttacggngacgtgacggcgggctcggcgaacgg

SEQ ID NO: 328140 - DNA, 542 bp, Homo sapiens
  misc_feature: GZ8MTXP01BPT2P.15.1.A01.1.454.CMB.2.raw
  modified_base (332)..(332): a, c, t, g, unknown or other
  misc_feature (332)..(332): n is a, c, g, or t
  modified_base (501)..(501): a, c, t, g, unknown or other
  misc_feature (501)..(501): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttatgaggaccacaagcgaccctcaggtcttctaatcgcttctctgctccaagtctggcaacacgcctcctgacatctccgngggctcgagctagacgtaacgaggtactaaagttattactgctgctcatatgtaagttataaacataatactagttcgggcggaaggtacccaaggctgaccgtctgccgtcacgcccgaagtcctaccgtccccgtcggtccaccgttctccgttccccgcccttccnccgttcttaccgtaagaccgtggacgcgggctggcgaacgg

SEQ ID NO: 328141 - DNA, 612 bp, Homo sapiens
  misc_feature: GZ8MTXP01A7O4T.15.1.A01.1.454.CMB.2.raw
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggnagacgacccccaaatcatgatttatgaggccactaagccgaccctcgagggtctttactaatcgctttctctggctcaagtctggacaacncggcctcctgacatctccgtgggctcgagctagacgngagcttaattatactgctgctcatagtagtaagttataactacttaatacgtagttacgggacggtaagggaccctaaaggggtccgtaggaaccccgttccgtcggtccggtaccacggtaccccgaaggtcccgtcccgtccccccgtcggttaaccaccgtttccttcccggtttccccgacccccttcgttcccgttccttacggtaacgtaccgtggaccgggtcgggttccgtcggaaccggaacggg

SEQ ID NO: 328142 - DNA, 858 bp, Homo sapiens
  misc_feature: GZ8MTXP01BDQ8C.15.1.A01.1.454.CMB.2.raw
  modified_base (250)..(250): a, c, t, g, unknown or other
  misc_feature (250)..(250): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttggggttatcacttgtctctggtaccaacaccacccggcagacgccccaaatcatgattangagtcacaagcgacctgaggtctttctaatcgtctttctcgtcggtctacccgaagttcgtacgggaccaaacccgaccgggtccccttccccgttacggaacctaaagttcccgttcccgtcgggggtcctacccgacggggtccctaacgggaaaccggaacgggtaaacgggttacctttaaaacttttaacgtttaacccgttggtctttcggtacctttacgtaattaaacggttaaggttaaaacggttttaaaactaaaaccgttaaactttaacgtttaaaccggtttaacgggtttaacccgggggacgggggtaaaccgggggaaacccgtaaacgggggtcccgtttacggggtaaacccccggttccggttccggttacccgggtaccgtaaacccgggacccccggtaaacgggtccccgttaccccgggtccccccccggttccgggtccccttaacccgttccccgtttaccccggtttccccccgtaaacccccttccccgttccccggttaccgttaacccgggtaacggttaacccgtcggggtaaccggggccggggttaccgggtaacggggaaccgtaaaccggggg

SEQ ID NO: 328143 - DNA, 591 bp, Homo sapiens
  misc_feature: GZ8MTXP01COCJF.15.1.A01.1.454.CMB.2.raw
  modified_base (262)..(262): a, c, t, g, unknown or other
  misc_feature (262)..(262): n is a, c, g, or t
  modified_base (586)..(588): a, c, t, g, unknown or other
  misc_feature (586)..(588): n is a, c, g, or t
  modified_base (590)..(591): a, c, t, g, unknown or other
  misc_feature (590)..(591): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattgagaacaccgtgattctaatatgaacagccngagagccgatgacacggctgtgtatttctgtgcgaagagacggtataatgttactggttgccacgtcgggaccaggaccctggtacaatcgtctcgtcagccctaccaccgaacgggcccactccggtccttcccccgcggccctacccctaccctaccgaaacgacgaccaccttcgcgggggaccacgggacgcccggggtcccctggggcctcggtcccgtgggttaccgaaacgggtaccttacccgttcccggaccttaaccggtaacgaccggttaggacgggtcggggcttcggggcgaaacgggccgacgaagagnnngnn

SEQ ID NO: 328144 - DNA, 570 bp, Homo sapiens
  misc_feature: GZ8MTXP01AEIH9.15.1.A01.1.454.CMB.2.raw
  modified_base (253)..(253): a, c, t, g, unknown or other
  misc_feature (253)..(253): n is a, c, g, or t
tcagtctacgtagccacgaccggtgctcgatttagacgtctcatcagggcgttgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcagacgcccccaaatcatgatttangaggccacaagcgaccctcagggtctttctaatcgcttctctggctccaagtctggcaacacggcctcctgacatctcgtgggctcgagctgacgcgagctaattatactgctgctacatatagtaagttataacactaatactagttcggacggtagggaaccaaggctacggacccgttccgtcggaccgttacgacccgtaagggtccctccggtcccccttcgggtccaaccgttccttccgttcccccaccctccctcggccttacggttacgaaccgtggaacggcccggggtcgttcggaacgaacggcg

SEQ ID NO: 328145 - DNA, 702 bp, Homo sapiens
  misc_feature: GZ8MTXP01EWUAI.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttaattttaaaaggtgtccagtgtgaggtgcagcgtggtggagtcggtggggggagtcgttgggtccgacgggccggggggtccctggacgactctcagtgtgcgaggtctcgtggtattcgaggtcgtacgaaggtaaatagttacagtggtaggttcgggtcccgccgaggcctccgaggggcgagggggctaggagtggctctacaatgattaccgaccgaggtccgggggacggtcggaaccaactactaaaccgtacgctaagtacgttccggaggtaaacggggcaagtacttaccaacctacgtacctaccgaagaacgtaaactaaagtttacggaaacgtaaactaccggtataactttacgttaaaataacgtacgtaaaccgacgtccgtaggaacgtacgaaccggtataggacccgtacggtcgtaaggttagtttattcgttaggtggacggttaagttaacgggttaagggttaataaagttaacggttacgttgggtttcggaacccgttaacggggtaacccgggg

SEQ ID NO: 328146 - DNA, 579 bp, Homo sapiens
  misc_feature: GZ8MTXP01B3IM5.15.1.A01.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
  modified_base (476)..(476): a, c, t, g, unknown or other
  misc_feature (476)..(476): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccgcagacgccccaaatcatgattangagccactaagcgaccctcaggctttcaatcgcttctctggctacaagtctggccaacacggcctccctgacaatctcctggctcccgaggctaagaacgaacgacggtacttaaattagttaccngtactgctcatagtagtaagttaataacacttatacctagttcggacggaagggtacccaaggcgttacgacctccgtgccgtcgacgacccgaaggtcccncccgtcccctcggtcctaccgttcctcccgttcccctaccccgtcccgttaccgccgttacgtaacgacgtcggacgggtcgggttacgtcggaacgtaacgg

SEQ ID NO: 328147 - DNA, 538 bp, Homo sapiens
  misc_feature: GZ8MTXP01AFFJ1.15.1.A01.1.454.CMB.2.raw
  modified_base (378)..(378): a, c, t, g, unknown or other
  misc_feature (378)..(378): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctgtaccaacaccacccggcagacgcccccaaatcatgatttatgaggccactaagcgaccctcaggtctttcaatcgtcttctctggctccaagtctggcaacacggcctcctgacactctccgtgggctccgaggctagacgaacgagctaattatactgctgctcatanagtaagttataacactatactagttcggacggagggaccaagggctcgaccgtccgtgccgtcgacgacccgaaggtcctccgcccccgtcggtccaccttctaccgttccccaccctccttcgcttacgtaagacgtggacggcgggctcggcgaacgg

SEQ ID NO: 328148 - DNA, 654 bp, Homo sapiens
  misc_feature: GZ8MTXP01BJSLH.15.1.A01.1.454.CMB.2.raw
  modified_base (323)..(323): a, c, t, g, unknown or other
  misc_feature (323)..(323): n is a, c, g, or t
  modified_base (402)..(402): a, c, t, g, unknown or other
  misc_feature (402)..(402): n is a, c, g, or t
  modified_base (490)..(490): a, c, t, g, unknown or other
  misc_feature (490)..(490): n is a, c, g, or t
  modified_base (515)..(515): a, c, t, g, unknown or other
  misc_feature (515)..(515): n is a, c, g, or t
  modified_base (563)..(563): a, c, t, g, unknown or other
  misc_feature (563)..(563): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctatttaaaaggtgtcagtgtgaggtgcagctggtgggagtcggtggggggaggtcgttcgggtccgacggggcccgggggggttccctggacgactctcagtggtcgcgaggtctcgtgggtattcgaggcgtagaaggaatagtacagtggaggttcgggtccncgaggctccggaggggcgaggggctaggagtggctcgtacaatgtaattacgacgtaggtcggggacggtcggaaccanataaacctacgcgagtacgtccggtaggaaagggcaagtacttcaactatccacgaagagaaacttaagttggaaacgaacctacgtntaactttactaaatatacggaaacncgacgaggacgacgacgagtacgacgtcgtgttgttagtttagttcgngtacggaacggttaaggttaacgggttaacggttaaattaaggttaacggtttacggttgggttaccggaaccggttaacggggtaacggg

SEQ ID NO: 328149 - DNA, 551 bp, Homo sapiens
  misc_feature: GZ8MTXP01AJRN2.15.1.A01.1.454.CMB.2.raw
  modified_base (273)..(273): a, c, t, g, unknown or other
  misc_feature (273)..(273): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccacccggcagacgcccccaaactcatgatttatgaggccactaagcgaccctnagggctttctaatcgcttctctggctccaagtctggcaacacggccctcctgacaatcctcctgggctccgaggctaagacgaacggaggactaaattatactgctgctcatatagaaagttataaacactaatactagttcgggacggaggaccaagggctaggacccgtcctcggccgtcgacgacccaacggtcctccgccccctcggtccacttcctccgttccccacccgtcccttcgcttacgtaagacgtgacgcgggactcggcgaacgg

SEQ ID NO: 328150 - DNA, 658 bp, Homo sapiens
  misc_feature: GZ8MTXP01DMUN5.15.1.A01.1.454.CMB.2.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (346)..(346): a, c, t, g, unknown or other
  misc_feature (346)..(346): n is a, c, g, or t
  modified_base (404)..(404): a, c, t, g, unknown or other
  misc_feature (404)..(404): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggnagacgccccaaatcatgattangaggccactaagcgaccctcgagggtctttctaatcgtcttcctctggcctccaagtctggaccaacaccggtccctccctagactaactctccgngggcctaccgaggtcctaggaaccgcggaggtaccttaaattattacctgactgctanatatagtaagttaataaactacttatacgtagttcgggacgggaacgggaaccgaagggtctacggtaacccgttccgttcggaccgttacgaaccggtaccccggaaacggtcccgttcccggtcccccccgttcgggttaaccccttcccgttcccgtttcccgtttccccccggtccccttcccgttccccgttccgttaaccggtaacggtaaccgttcggacgggtcgggccgtcgggccgaaccgggg

SEQ ID NO: 328151 - DNA, 530 bp, Homo sapiens
  misc_feature: GZ8MTXP01A3RAF.15.1.A01.1.454.CMB.2.raw
  modified_base (351)..(351): a, c, t, g, unknown or other
  misc_feature (351)..(351): n is a, c, g, or t
  modified_base (481)..(481): a, c, t, g, unknown or other
  misc_feature (481)..(481): n is a, c, g, or t
tcagtctacgtagccacgaccggtgctcgatttagacgtctcatcagggcccgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccgcagacgccccaaatcatgattatgacggccactaagcgaccctcagggtctttctaatcgtcttctctgctcaagtctggcaacacggcctcctgacaatctcgtcggctcgaggctgaacgacgnggactaattattactgctgctacatatagaagttataactactactactagttcggacggaggacgaagcgtcgaccgtccgtgcgtcacgcccgaagcctccgcccctcggtccaactcttcgtccccncctccgtcgttcgttaccgttagctgaacggcggcgacggcgaacggcg

SEQ ID NO: 328152 - DNA, 567 bp, Homo sapiens
  misc_feature: GZ8MTXP01EVZCP.15.1.A01.1.454.CMB.2.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccacccggcagacgcccccaaatcatgatttangaggccactaagcgaccctnagggtctttctaatcgctttctctggcctcaagtctggacaacacggcctcctgacatctctgggctcgaggctagacgcgagtacttaattattactgctgctacatatagtaagttataaacacttaatactagttcggacggtaacggaccaaggctacgaccgtcgtgcgtcacgacccgtaaggccctccgtcccccgtggtccctacttccgtcccgttcccctaccccgttccgttcgttccttaccggtaagacgtggacgggcgggttctcgggaacgaacggg

SEQ ID NO: 328153 - DNA, 515 bp, Homo sapiens
  misc_feature: GZ8MTXP01DMVFP.15.1.A01.1.454.CMB.2.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcagacgcccccaaatcatgatttatgaggccactaagcgaccctnaagggctttctaatcgcttctctggctccaagtctggcaacacggcctccctgacatctctgggctcagctgacgngaggctaaattatactgctgctcatatgaagttanaaacataatactattcggcggagggaccaagggctagaccgtcctgcgtcagacccaaggcctacgccccctcggtcctacttctcgttcccaccctccttcgcttacgtgactcggagcgggctggcgaagg

SEQ ID NO: 328154 - DNA, 551 bp, Homo sapiens
  misc_feature: GZ8MTXP01ACP11.15.1.A01.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctgtaccaacaccacccggnagacgcccccaaatcatgatttangaggccactaagcgaccctcgagggtctttcaatcgctttctctggctccaagtctggcaacncggcctcctgacatctcctgggctccgaggctagacgaacgagtcttaaattntactgctgctacatatagtaagttanaacactatactagttcggacggagggacaagggtcncgaccgtcgtcgcgtcgacgacccgaacggtcctccggcccctggtccncttccgtccgttccccgtcccttacccttcgttccttacggtaacgtacgtgacggcgggctcgggcgaacggg

SEQ ID NO: 328155 - DNA, 543 bp, Homo sapiens
  misc_feature: GZ8MTXP01AXQJG.15.1.A01.1.454.CMB.2.raw
  modified_base (316)..(316): a, c, t, g, unknown or other
  misc_feature (316)..(316): n is a, c, g, or t
  modified_base (514)..(514): a, c, t, g, unknown or other
  misc_feature (514)..(514): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaatcatgatttatgaggcactaagcgaccctcgagggctttctaatcgcttctctggctccaagtctgcaacncggcctacctgacatctcctcgggctcccgaggctacggacgaacgaggtctaagttattactgctgctcatatgaagttataaacactatactagttcggacggacgggacaaggctgacccgtcgtgccgtcacgaccaacgcctaccgcccctcggcaccgttcttcgttccccaccctccttcgcttacgtaancgtaacgcgggcggacgtcggcgaacggg

SEQ ID NO: 328156 - DNA, 723 bp, Homo sapiens
  misc_feature: GZ8MTXP01C9UN9.15.1.A01.1.454.CMB.2.raw
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacctttgtctcctaggtaccaaccaccaccccggcacgacgacccccaaatcatgatttanagaggccaanaacgcgaccctgaggtctttacaatcgtcttctctcggcctccgaagttctagggaccaaaccgacccgggccccttaccccgtagaacctaaacttcctcccgtcggggcttacccgaggtccgtaacggaaccgaacggtaacgggtacctttaaaagtttattaaccgtggtacttcgtactactaaattaagttaggtaaaggtttaactaaactaacttaattaaccgttaagttacgggacgggaacggggtaaccaacggggtccgttacggtacccgtaccgttcggaccgtccgaccgacccgaacggtcctcccggtacccccgttcggtccctaacccttccgttcccgttcccccgtaccccttcccgttcccggaaccgtttaaccggtaacgtaccgttcgggaccgggtcgggccgttaacgggaacgtaaaccggg

SEQ ID NO: 328157 - DNA, 588 bp, Homo sapiens
  misc_feature: GZ8MTXP01A2LZ9.15.1.A01.1.454.CMB.2.raw
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggagtcgtgggggaggcttggtccgaggccgggggggtccctgagactctcatgtgcaggctctggattcagcgtcaggaatagttacatgagttgggccgccaggctccgaggggcagggggctagagtggctcncaatgatttacaccgagtcgggggacggtagggaccanataacacgcagattccgaggaacgggcagacttcacactctccagagaacaagtttggaacgaacaccgtagactttacttaataatagaacagcctagagacgaccgagtacgacgacggcgtgttgttatttcgttggttcggacggaggttaggttacggggttaattaaagttaaggtttaacgttgggtttcggccgttaacgggtccggggg

SEQ ID NO: 328158 - DNA, 582 bp, Homo sapiens
  misc_feature: GZ8MTXP01DYIMO.15.1.A01.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (379)..(379): a, c, t, g, unknown or other
  misc_feature (379)..(379): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttggggttatcacttgtctctgtaccaacaccacccgnagacgccccaaatcatgattangagccaacaagcaccctnaggtctttctaatcgtcttctctgctcaagtctggacaacacggcctcctgaacaatctcctcgggctccgagctaaggacgaacgaggtacttaaatttattactgctgctntatatagtaaagttaataaactacttaatactaacgttcgggacgggtaacggaccaaggtcgtacgtacccgtccgtcgccgtcgacgacccgaacgtccctaccgcccccgtcggtcctaccttcccgtccgttcccccgtaacccttcccgttaccgccgttacgtaacgtaccgtggacggcgggctcgggcgaacggg

SEQ ID NO: 328159 - DNA, 519 bp, Homo sapiens
  misc_feature: GZ8MTXP01EDWOG.15.1.A01.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (463)..(463): a, c, t, g, unknown or other
  misc_feature (463)..(463): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnagacgcccccaaatcatgatttatgaggccactaagcgaccctnagggtctttctaatcgcttctctggctcaagtctggcaacacggcctcctgacaatctctgggctcgaggctagacgcgagtctaaagttatactgctgctcatatgtaagttataaactactatactagttcggcggaggaccaaggctagaccgtcgtgcgtcacgcccaaggcctccgcccctcggtcncttcgtcttcccaccctccttcgcttacgtgacgtggacggcggctcgggcaacgg

SEQ ID NO: 328160 - DNA, 626 bp, Homo sapiens
  misc_feature: GZ8MTXP01CNRA0.15.1.A01.1.454.CMB.2.raw
  modified_base (299)..(299): a, c, t, g, unknown or other
  misc_feature (299)..(299): n is a, c, g, or t
  modified_base (539)..(539): a, c, t, g, unknown or other
  misc_feature (539)..(539): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccgaggcccggggggtccctgagactctcatgtgcaggctctggattcagcgtcaaggaatagttacagtgaggttgggtccnccgaggctccgaggggcgagggggctaggagtggctctcaatgatttacacggtagtcgggggacggtgggaccacataactacgcagtacgttccggtaggaacggggcaagtacttccgaacctactacctaccaagaacgtaactaaagtttagggaacgtaaccaccgtagtatttacttaatactagaacagtacctagagacgaccgagtcgacgacggtctgtgttatttcgnggttagcggttaaggttaggttacgggttaaagttaagttaacgttacggttcgggtttacggtcccgttaacgggtaacccggggg

SEQ ID NO: 328161 - DNA, 604 bp, Homo sapiens
  misc_feature: GZ8MTXP01C5J71.15.1.A01.1.454.CMB.2.raw
  modified_base (192)..(192): a, c, t, g, unknown or other
  misc_feature (192)..(192): n is a, c, g, or t
  modified_base (377)..(377): a, c, t, g, unknown or other
  misc_feature (377)..(377): n is a, c, g, or t
  modified_base (533)..(533): a, c, t, g, unknown or other
  misc_feature (533)..(533): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttattttaaaaggtgtccagtgtgaggtgcagntggtggagtcgtgggggagcgttggtccgaggcccgggggggtccctgagactctcatgtgcaggctcgtggattcagcgtcaggaatagttacatgagttgggtccgccgaggcctccgaggggcgaggggctagaggtggctcgtcaagtgatttacgacgagtcgggggacggtgggaccanactaaactacgcaagtacttccggtaggaaggggcaaggtattaccaccatctccagaagaactaaatttggaacgaaaccacgtagtaattacttaaatagtaagaacacgtcctagacgtacgaccgatacgacgacggcttgtgttactttgngttggcgttaggaggttagggttaattaagttaagttacgttgggttacggtccgttaacgggtaacgggg

SEQ ID NO: 328162 - DNA, 750 bp, Homo sapiens
  misc_feature: GZ8MTXP01C8FTB.15.1.A01.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctacttgtctcctacgtaccaaccaccacccgcacgaccgaccccaatcatagtattangagccaanaacgcgaccctgaggtctttactaatcgtcttctcgtcggtcctaccaagtcgtacggacctaaaccgacccggccctccgtagaacctaaactccgtaccgtcggggccttaccgaggcgtaacggaaccggaacgtaaacgggtaactttaaatttaactttactcggtctacgtcttacaattaagttaaggtaaaagtttaaactaaactaactttaactaacgttaacggttaccggggaacgggtaaacgggaacccgtaaacggggtcccgttaccggtaaccccgttccgttcggtacccgtaccgaaccggaccccgtaaaccgggtcccgtaccccggtccccccgttacgggtaacccttcccgttcccgtttccccgttccccccgtcccctttccccgttccgttaccgttaaccgggttaacgtaaccgtcgggaacgggccgggttaccgtaacggcggtaaaccggg

SEQ ID NO: 328163 - DNA, 609 bp, Homo sapiens
  misc_feature: GZ8MTXP01CGXIP.15.1.A01.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttggggttatcacttgtctctggtaccaacaccacccggnacgacgaccccaaatcatgattangagccanaacgcgacctcaggtctttactaatcgtcttctctggctccaagtctggcaacgccggcctcctagacatctccgtggctcgagcgtacgacgcgaggtacttaaatttactactgctcgctcaattagtaggtaaaggttaataaacctacttaacttacgttaaggttcgggaacgggagggaacccgaggcgtccgaccgtcctcgccgtccacggaccccgaaggtcccgtccggtccccccgttcggtccctaccttcccgttcccgttaccccctacccgttcccgttaccgccgttaaccggttaaccgacgtcggacggtcgggaccgtgggaaccgaacgg

SEQ ID NO: 328164 - DNA, 575 bp, Homo sapiens
  misc_feature: GZ8MTXP01A7O1X.15.1.A01.1.454.CMB.2.raw
  modified_base (403)..(403): a, c, t, g, unknown or other
  misc_feature (403)..(403): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggaggtcgtgggggaggcttggtccgagggcccgggggggtccctgagactctcatgtgcgaggctcgtggtattcgagcgtcaaggaatagttacagtgagttcgggtccgccgaggcctccgaggggcgagggggctaggagtggctctacaatgatttacgacgtagtcggggacggtggaccacataacacgcagacttccgngaagggcagtatcacatctacagagactaagtttggaacaacacgtagtatttacttaaatatagaacagacctagagacgaccgagtcgacgccggtntgtgttagtttcgnggtagcgagacgttagggtaatagttaagttacgtgggtttcgccgttaacggtcgggg

SEQ ID NO: 328165 - DNA, 622 bp, Homo sapiens
  misc_feature: GZ8MTXP01BV9I7.15.1.A01.1.454.CMB.2.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccgtgaagggcagattcaccatctcagagacaatttggagaacaccgtgatttacttaaatatagaaacagcctagagacgccgatgacacggntgtgtatttcngtgcgagagacggtataatagttactggttgccagtcggggccagggaccctggtnaacgtcgtctcgtcacgcccctaccaccgaacgggcccctacgttcccggtcccttcccccgtcggccctacccctacccctacccgaacgtaccgaccacccgttccggtcgggggcccacgggacgggccgggcccgtcgggccgtccggccgtacggtaccgaaacggtaccgttaccgttcccgtacccgttaacgtacggttacgttcgggacggaccggggtcgttcgggcgaacggggcgacgaagtaggngnngngn

SEQ ID NO: 328166 - DNA, 580 bp, Homo sapiens
  misc_feature: GZ8MTXP01D7NQ7.15.1.A01.1.454.CMB.2.raw
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcaccttgtctcctgtaccaacaccacccggcacgacgcccccaaatcatgatttangaggccaactaacgcgaccctcgaggtctttctaatcgtcttctctggctccaagtctggacaacacggcctcctgacatctcctggctcgagctagacgcgagtctaattatactgctgctacatagtagtaagttataaacacttaatactagttacgggacggaaggaccgtaaaggctggaacccgtccgtcggccgtccgacgaccccgaaggtccctccggtcccccgtgggtaacctaccttcctccgtttcccccaacccgttcccttccgccgttacgttaacgcttcggacgggcgggactcgggcgaaacggg

SEQ ID NO: 328167 - DNA, 615 bp, Homo sapiens
  misc_feature: GZ8MTXP01AK5H2.15.1.A01.1.454.CMB.2.raw
  modified_base (326)..(326): a, c, t, g, unknown or other
  misc_feature (326)..(326): n is a, c, g, or t
  modified_base (393)..(393): a, c, t, g, unknown or other
  misc_feature (393)..(393): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacacccaccccggcacgacgacccccaaactcatgatttatgaggccacaacgccgaccctcgagggtctttctaatcgtctttctctggctaccaagtctggacaacncggtccctcctgacaactctcgtgggctccgaggctagacggcgaggacttaagttattactgctcnctatatagtagtaagttaataactactaataacgtacgttacgggacgggaacggacgaacgggtcgtacggtcccgtccgtcgtccgtacgaccggacccgacggtcccgtccccggtcccccgttccggtccctccttcccgttcccgttccccgtaccccttcccgttccgttaccgttacggtaacgtacgtggacgggtcgggcgtcggcgtaacgg

SEQ ID NO: 328168 - DNA, 606 bp, Homo sapiens
  misc_feature: GZ8MTXP01EGKI9.15.1.A01.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (384)..(384): a, c, t, g, unknown or other
  misc_feature (384)..(384): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctgtaccaacaccacccgnagacgccccaaatcatgatttangaggccactaagcgaccctcgaggtctttctaatcgtcttctctggctccaagtctggacaaccgacggccctcctgacaatctcgtgggctcgaggctagacgcgagtaccttaaattacttactgctgcctanatagtagtaaaggttaataaactacttaataacgtagttacgggacggaacgggacccaaaggggtcctacggtaacccgtccgtgccgttacgacgacccgtaacggtccgtccgcccccgttacgggtcctaccgttcctcccggttcccccgtcccttcccgttacgttccgttacgtaacgtaccgtgggacggccgggttacgtcggaacgaacggg

SEQ ID NO: 328169 - DNA, 649 bp, Homo sapiens
  misc_feature: GZ8MTXP01D9R4D.15.1.A01.1.454.CMB.2.raw
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggagcttggtccaggccggggggtccctgagactctcatgtgcaggctctggtattcgaggcgtacgaaggaatagttacatggagttgggtcccgccgaggcctccgagggcgaggggctagagtggctctcaatgtattacgaccgagtcggggacggtggaccacataacctacgcgagtacgttccggaggaacgggcaagtacttaccgacctactacctaccgaagaagaaacgtaaagttttagggaacgtaaaccgtacccgtagtaactttacctttaaagttaattacggaaacacggaccgtacggacgacgaccgtagtacgaccgacggtctaagttgttatttcgttgtcggtacggaggttaggttaacgggttaagttaaagttaaggtttacgttagggtttacggtaacccgttaacggtaaccggggg

SEQ ID NO: 328170 - DNA, 547 bp, Homo sapiens
  misc_feature: GZ8MTXP01EI61H.15.1.A01.1.454.CMB.2.raw
  modified_base (181)..(181): a, c, t, g, unknown or other
  misc_feature (181)..(181): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(547): a, c, t, g, unknown or other
  misc_feature (543)..(547): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccanatactacgcagattccgtgaagggcagattcaccatctccagagacaatttggagaacaccgtgattcttaatatgaacagcctgagagccgatgacacggctgtgtatttctgtgcgagagacggtataatagttactggttgccagtcggggccagggaccctggtcaatcgtctcgtcacgccctccaacgaagggcccctacgtcggtccttcccccgtcggccaccctccctaccaagcgcaccgtcgtcgggggaccacgggacggccggcccgttggggcctcgaccgttggtacgaacggtacctacgttccgcgtaacgtagacgtgacggcgggcttggcgaggcgnaangnnnnn

SEQ ID NO: 328171 - DNA, 510 bp, Homo sapiens
  misc_feature: GZ8MTXP01BIDNU.15.1.A01.1.454.CMB.2.raw
  modified_base (250)..(250): a, c, t, g, unknown or other
  misc_feature (250)..(250): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (426)..(426): a, c, t, g, unknown or other
  misc_feature (426)..(426): n is a, c, g, or t
  modified_base (487)..(487): a, c, t, g, unknown or other
  misc_feature (487)..(487): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcagacgccccaaatcatgatttangaggccactaaagcgaccctcagggctttctaatcgcttctctggctccaagtctggcaacacggcctccctgacaatctcngggctcgagctgacngagctaaagttattacngctgctcatatgaagttataaacactatactagttcgacggaaggtaccaggctgaccgtcngcgtcagcccaaggtcctacgcccctggccacttctcgttcccgccctcttcgcttacgtnacgtgacgcggctcggcgaacgg

SEQ ID NO: 328172 - DNA, 787 bp, Homo sapiens
  misc_feature: GZ8MTXP01B7I1N.15.1.A01.1.454.CMB.2.raw
  modified_base (270)..(270): a, c, t, g, unknown or other
  misc_feature (270)..(270): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttactctaccttgtcctccgtcggtaacccaaccacccgaccccggcacgaccgacccccaaatcatgatttangacgccacaacgccgaccctcgaggtctttactaactcgtcttcgtcgtggtcctaccgaagtcgtacggaccaaacccgaccggtcccttaccccgtagtaacctaacgttccgttcccggtccggggtacctaccggtaaggggccttaaacgggaacccgggtaacggtaagggttaaccctttaaattttacgttaaccgtcgtacgttcgtaccttacgtaattaacggttaaggttaaaaggtttaaactaaacctaactttaagttaaaccgttacggttccggggaacggggtaacgggaaccccgtaaggggtaccgttacgggtaccccgttaccgtcgtacccgtaccgaccggaccccgtaacggtccccgttcccggtcccccgttccggtccctaccgtttcccgttccccggttcccccgtcccctttcccgttacccggttccgttaacgggtaacggtaccgtgggaccggggtcgggacggtaacgggaacgtaacggg

SEQ ID NO: 328173 - DNA, 681 bp, Homo sapiens
  misc_feature: GZ8MTXP01ED5OT.15.1.A01.1.454.CMB.2.raw
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctacttgtctcctgtaccaacaccacccgcacgacgaccccaaactcatgtattangacgccaacaacgccgaccctcgacggtctttactaactcgtcttctcgtcggcctaccgaagtcgtacggaccaaccgaccggtcccctaccgtacgaactactcgtccgtcgggctccgaggctaacggacgaacggagtacttaaattacttacgtcgtctcgtctactaagtagttaaggtaaagttaactaaactaacttaacttaacgttacggttaccgggacggggtaaacggggacctaaacggggccgttaccggtacccgttccgttacggccgtaccgaccggaccccgaacggtcccgtccccgtacccccgttcggtaaccctaccgttcccttcccgttccccctacccttcccgttaccgttccttacggtaacgacgtcgggacggtcgggacgtcgggaacgaacgg

SEQ ID NO: 328174 - DNA, 511 bp, Homo sapiens
  misc_feature: GZ8MTXP01B8P6P.15.1.A01.1.454.CMB.2.raw
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (486)..(486): a, c, t, g, unknown or other
  misc_feature (486)..(486): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggnagacgccccaaatcatgatttatgaggccactaagcgaccctnagggctttctaatcgctttctctggctccaagtctggcaacacggcctccctgacaatctctgggctcgagctagacgcgagcttaaattatactgctgctcatangaagttataacactatactattcgnggaggacaggctgaccgtcctgcgtcagacccaagcctcgccccctggtccacttctcgttccccgtccctccttcgcttacgtnacgtgaggcggcgtcggcgaacggg

SEQ ID NO: 328175 - DNA, 665 bp, Homo sapiens
  misc_feature: GZ8MTXP01BU966.15.1.A01.1.454.CMB.2.raw
  modified_base (255)..(255): a, c, t, g, unknown or other
  misc_feature (255)..(255): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcacgacgaccccaaatcatgattangagccacagcgacctgaggtcttcatcgtcttctctggctcaagtctaggacaaccgaccggccctccctagaacaacttccgtccgtcgggcctaccgaggccgtaagaaccgaacggaggtaccttaaatttacttacgtcgtacgtcgtaccttagtaattaagtaaggttaaaaggttaaactaaactaaccttaattaaccgttacggttaccggggacgggaaacggggtaacccaaacggggtccgtacggtaacccgttccgtacgccgtaccgacggaccccgaagtccccgtccgtcccccgtcggtaacctcgttcctcccgttcccccacccgttccgttaccgttcgttaaccgtaacgtacgtcggaacggcgggttcctaagggaaccgaacggg

SEQ ID NO: 328176 - DNA, 600 bp, Homo sapiens
  misc_feature: GZ8MTXP01AJZTF.15.1.A01.1.454.CMB.2.raw
  modified_base (492)..(492): a, c, t, g, unknown or other
  misc_feature (492)..(492): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctcctggtaaccaacacccacccggcacgacgaccccaaatcatgtattatgacgaccacaacgccgacctgaggtctttctatcgtctttctctcggcctaccgaagtcgtcggacctaacgacccggtcctccccgtagaactaactctccggtcgggcctccgaggtcctaacgggaacgaacgtagtacttaaagtttatactgctgctacatataggtaagttataacaactatacgtacgttcggacggacggacaacggtctacggacctcgtgccncgacgaccgacggtcctaccgccccgtcgtccaccttccgtcccttccccgcccttccgttcgttacgttacgtaagccgtggacgggcggttactcgggcgaacggg

SEQ ID NO: 328177 - DNA, 561 bp, Homo sapiens
  misc_feature: GZ8MTXP01BTBMD.15.1.A01.1.454.CMB.2.raw
  modified_base (434)..(434): a, c, t, g, unknown or other
  misc_feature (434)..(434): n is a, c, g, or t
  modified_base (556)..(558): a, c, t, g, unknown or other
  misc_feature (556)..(558): n is a, c, g, or t
  modified_base (560)..(561): a, c, t, g, unknown or other
  misc_feature (560)..(561): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacggtataatagttactggttgccgactggggccagggaaccctggtcaagtcgtctccgtcacgccctaccaccgaaaggggcccctacgtcgtcccttcccccgtcggccacccctccctaccacgacncacctcgtgggggccacggacggcccggcccgtcggggccgtcgcccgtgggtacaacggtactaccttccgctaacgttcgacgtcggacggccgggtcttggggccagggcgcgaatggnnngnn

SEQ ID NO: 328178 - DNA, 733 bp, Homo sapiens
  misc_feature: GZ8MTXP01CKZ5A.15.1.A01.1.454.CMB.2.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctgtaccaacaccacccgnacgacaccccaatcatgattngagcacagcgaccctgaggtcttactaactcgtcttctcgtggtcctaccgaagtcgtacggaccaaccgtacccggtccctacccgtagaaacctaacttccgttcccgtcggggccttaccgacgggtcctaacgggaaccggtaacggtaaggtaacctttaaaattttacgttaacgtcggtccttacgtaccttacgtaaagtttaagtaaggttaaaacggtttaactaaacgtaacttaattaaccggttaaggttccggggaacggggtaaacgggaaccctaaaggggtcccgttacggtaccccgtccgtacggcccgtaccgaccgtaccccgtaacggtcccgttccccggtcccccgttcggtaaccctacccgttcccggttccccgttacccccgtccccttccgttcccgttccgttaaccggttaacgaccgttcggaccgggccgggttacgtcggaacgaaccggg

SEQ ID NO: 328179 - DNA, 537 bp, Homo sapiens
  misc_feature: GZ8MTXP01EW7HW.15.1.A01.1.454.CMB.2.raw
  modified_base (275)..(275): a, c, t, g, unknown or other
  misc_feature (275)..(275): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctnagggctttctaatcgctttctctggctccaagtctggcacacggcctcctgacaatctcctgggctccgagctagacgcgagactaattattactgctgctcatatgtaaggttataaacactatactattcggcggaggaccaaggctcgaccgtcctgaccgtcacgcccaaggtcctcgcccccgtcggtcctacttcctccgttcccctaccctcccttccgcttacgtcgacgtgacggcgggctcgggcgaacggg

SEQ ID NO: 328180 - DNA, 640 bp, Homo sapiens
  misc_feature: GZ8MTXP01BUKTT.15.1.A01.1.454.CMB.2.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (545)..(545): a, c, t, g, unknown or other
  misc_feature (545)..(545): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctctggtaccaacacccacccggnacgacgaccccaatcatgatttangagaccanaacgcgaccctgacggtctttcaatcgtcttctctggcctaccaagtctacggaccaacccgaccggcctaccctagactaatcgtccgtggctcgaggctaagacgcgagtacttaattacttacngtacngtctactaatanaggtaaagttactaaactacgttatacgtacgtacgggcggaacggaccaaaggtccgtttacggacccgttcctaggacccgttaccggaactaccccgggtagggtcccctcccgtccccccgttacggttaaccnccggtttccctttacccgccccctaaccccgttcgttaccgggttacttaaccggttgaaccgtcggaacgggcgggttcgtcggaacgaaccgg

SEQ ID NO: 328181 - DNA, 841 bp, Homo sapiens
  misc_feature: GZ8MTXP01AU5F0.15.1.A01.1.454.CMB.2.raw
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctcggtaccaaccacccaccccggnacgaccgacccccaaatcatgtatttangacggccaactaacgccgaccctcgagggtcctttactaatcgtctttctcgtcggcctaccgtaaagtccgtacgggacccaaaccgtacccgggtccccttacccccgtaggaacctaaacgttccgttcccggttcggggtaccttccgaacggggtccttaacgggaacccggaacgggtaagggtaccctttaaaagtttaactttaccgtcgtacgttcgtacccttaataagtttaacgttaacggtaaaaggttttaaacttaaaacccgtaacctttaaagttaaacccgtttaacgggttacccgggggaaccggggtaaaccggggtaaccccgtaaagggggtcccgttaccggggtaaccccgtttcccgtaggtaccccgttacccggaaccggtaccccggaaacgggtccccgttccccggtaccccccggttcgggtaaccccttaacccgtttcccgttccccggtttccccccggacccctttccccgttacccgtttacgggttaacgtccggttacgggaacgggtccggggcgttacgggaaccgttaacgggtccg

SEQ ID NO: 328182 - DNA, 585 bp, Homo sapiens
  misc_feature: GZ8MTXP01B0Z7G.15.1.A01.1.454.CMB.2.raw
  modified_base (325)..(325): a, c, t, g, unknown or other
  misc_feature (325)..(325): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcacgacgaccccaaactcatgatttatgaggccacaagcgaccctcaggtctttctaatccgctttctctggctccaagtctggacaacacggcctccngacatctcgtcgggactccgaggctagacgcgaggtcttaaagttattactgctcgctacatatagtaaaggttataaactacttaatacttacgttcgggacggaagggaccaaggggcgtacgaccgtccgtagccgtcgacgaccccgaaggtcctaccgtcccccgtcggtaacctacccttccgttccgttccccaccccttccgttcccgcttaccggttaacgacgtcggacggcgggcgtcgggcgaacggg

SEQ ID NO: 328183 - DNA, 789 bp, Homo sapiens
  misc_feature: GZ8MTXP01A583M.15.1.A01.1.454.CMB.2.raw
  modified_base (260)..(260): a, c, t, g, unknown or other
  misc_feature (260)..(260): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcaccttgtctcctggtaaccaacacccacccggcacgacgaccccaatcatgactttagngacggaccaacaacgccgaccctgacggtctttactaactccgtctttcgtccgtggtcctaccgaacgtcgtacggaccaaaccgcccggtcccttacccgtagaacctaaacgttccgtcccggtcgggtaccttccggaacgggtccgtaacgggaaccggaacggtaaacgggtacctttaaaatttacgtttaaccgtcgggtaccttacggtaccttactaaagtttaaggtaacggtttaaaacggtttaaacttaaacctaaacgtttaacgttaacgtttaaacgggttaccgggaaccggggtaaacgggtaacccgaacggggtaccgttaccgggaaccccgttcccgttacgaccggttaccgaaccggaaccccgtaacgggtcccctacccggtcccccgttacggtaaccctaccgtttcccgtcccgttacccccgtaccccttcccgttccgttaccgttaacggtaacgtaccgtcggtacgggccgggttacgtaacgggcgaaccggg

SEQ ID NO: 328184 - DNA, 554 bp, Homo sapiens
  misc_feature: GZ8MTXP01D9OAT.15.1.A01.1.454.CMB.2.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (432)..(432): a, c, t, g, unknown or other
  misc_feature (432)..(432): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctgtaccaacaccacccgnagacgaccccaaatcatgatttatgaggccactaagcgaccctcgagggtctttctaactcgctttctctggcctccaagtctaggacaacacggccctcctgacaatctccgngggctcgagctgacgcgagtctaattatactgctgctcatatagaagttataacactatactagttcgaggacgaccaagcgtgtaccgtcngaccgtcgacgaccgaaggtcctccgccccgtcggtcctacgttcctccgttcccctacccttcccgttccgttcgttaacgtaacgtaaccgtggacggcgggacgtcgggaaccgaaggg

SEQ ID NO: 328185 - DNA, 715 bp, Homo sapiens
  misc_feature: GZ8MTXP01ATC50.15.1.A01.1.454.CMB.2.raw
  modified_base (606)..(606): a, c, t, g, unknown or other
  misc_feature (606)..(606): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttattttaaaaggtgtccagtgtgaggtgcagcgtggtggaggtcgtggggggaggcgttgggtccgagggcccgggggggtccctgagactctcatgtgcaggctcgtggattcaggtcgtacaggtaatagttacagttggaggttcgggtccgccgagggcctccgaggggcagggggctaggaggtggctctacatgtactttacgaccgtaggtcgggggacggtacggggacctacgactaacgtacgcgaagtacgttccggtagggaaaggggcaagtaacttccgaaaccctatacctacccgaaaggtaagtaaaccgttaaagtttacggggaaagaaacccgtacccgggttgtaaacttttaccttaaagttaacgtaacgaaacccgtagacccgttagaacggtacgtacccgagttcgaacgaccgggttnttaagttcgttattcgttggtacggtacgttaaggttacggttaacgggttaattaacggtttaacggttcggttacgggttacggtaacccggttaacggggtccggg

SEQ ID NO: 328186 - DNA, 600 bp, Homo sapiens
  misc_feature: GZ8MTXP01CYABD.15.1.A01.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctagtaccaacaccacccgnacgacaccccaatcatgatttangagccacagccgaccctgaggtctttacaactcgtcttctctggcctaccgaagtctggaccaaccaccggccctacctcgaactatcctccgngggctcgaggctaggaacgaacgaggtacttaaattcttacngtctagctanaagtagtagtaaagttaataactacttaagtactaggtcggacggacggaaccaggtcgtcgtaccgtctgccgtacgacgacccgagtcccgtcccgtccccgtcggtcctaccgttccgttccgttccccctaccccgttcaaccggttccgttaaaccggtgtacgtcgggacgggtcgggccgtgggaaccgtaacggg

SEQ ID NO: 328187 - DNA, 533 bp, Homo sapiens
  misc_feature: GZ8MTXP01EY0TL.15.1.A01.1.454.CMB.2.raw
  modified_base (246)..(246): a, c, t, g, unknown or other
  misc_feature (246)..(246): n is a, c, g, or t
  modified_base (252)..(253): a, c, t, g, unknown or other
  misc_feature (252)..(253): n is a, c, g, or t
  modified_base (261)..(272): a, c, t, g, unknown or other
  misc_feature (261)..(272): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (347)..(357): a, c, t, g, unknown or other
  misc_feature (347)..(357): n is a, c, g, or t
  modified_base (359)..(359): a, c, t, g, unknown or other
  misc_feature (359)..(359): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcacgacgacccccaaactcntgactnntagacgcnnnnnnnnnnnntacgtacgtaccgtcgttacgtcttcgtactcgtacgtcgtcgtacgacncgacccncncncncncncncncncnnnnnnnnnnncncgctcactactcgtcgtctctctactactacgtactactactacgtacgtacgtacgtacgtacgtacgtacgtacgtacgtcgtcgtacgttacgtaccgaccgtaccgtccgccgttcccgttcccgtcccgtccgtcccgtcccgtccgttcccgtcccgttcccgtcccg

SEQ ID NO: 328188 - DNA, 654 bp, Homo sapiens
  misc_feature: GZ8MTXP01BNSKR.15.1.A01.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacaccacccggnacgacgccccaaatcatgatttangacgccactaacgcgaccctgaggtcctttctaatcgtctttctctcggcctaccaagtcgtcggaccaacccgaccggtccctaccctagaaccaattcctccgtgggctccgaggtcctaacggaccgaacggacgtacctttaaagttacttacgtgcttgccttacgtaattagtaagtaaaggtttaactaaactacttaactaccgttagttccgggacgggaacggtaacccgaaagggtccgtcggtacccgtcctacggccgtacgacgacccgtacgtcccgtcccgtccccgtcgtcctaccgttccttcccgttaccccaccccgttcgttacccgttcgttacccggtaacgtacgttcgggacggtccgggcgtaacggcgaacggg

SEQ ID NO: 328189 - DNA, 594 bp, Homo sapiens
  misc_feature: GZ8MTXP01EHUH3.15.1.A01.1.454.CMB.2.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (404)..(404): a, c, t, g, unknown or other
  misc_feature (404)..(404): n is a, c, g, or t
  modified_base (546)..(546): a, c, t, g, unknown or other
  misc_feature (546)..(546): n is a, c, g, or t
tcagtctacgtagccacgaccggtgctcgatttagacgtctcatcagggccgtggggctctgctgctcctcactctcctcactcaggacacagggtcctgggcccagtctgccctgactcagcctgcctccgtgtctgggtctcctggacagtcgatcaccatctcctgcactggaaccagcagtgatggttgggttatcacttgtctctgtaccaacaccacccggnagacgacccctaaatcattgatttangacggcctaactaacgccgaccctcgacggtctttactaatcgtacttctcgtaggtcctcccaaaggttcgtacggaccaacccgtacggtccctacccgttagaccaattctccgtgggctcaggctagacgcgagtctaagttatcngcttgcttagatagtagtaagttactaaactacttatactagttcgggaggaacgggtacaaggtcgtacgacctcgtggtccgcgacgacccgagtcctccgtccccgtaggtctaacttcggtaccttccctcccgtccncgttccgttacggtaacgtacgcgacggccgggttacgtcggcgtaag

SEQ ID NO: 328190 - DNA, 526 bp, Homo sapiens
  misc_feature: GZ8MTXP01BXFM3.15.1.A01.1.454.CMB.2.raw
  modified_base (249)..(249): a, c, t, g, unknown or other
  misc_feature (249)..(249): n is a, c, g, or t
  modified_base (326)..(326): a, c, t, g, unknown or other
  misc_feature (326)..(326): n is a, c, g, or t
  modified_base (385)..(385): a, c, t, g, unknown or other
  misc_feature (385)..(385): n is a, c, g, or t
  modified_base (461)..(461): a, c, t, g, unknown or other
  misc_feature (461)..(461): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctgtaccaacaccacccgcagacgcccccaaatcatgattangaggccactaagcgaccctcagggtctttcaatcgcttctctggctcagtctggcaacacgcctcctgacatctccngggctcgaggctagacgcgagtactaagttactactgctgctacatagtagtaagttanaaactactatactagttcgaggaggaccaggctgacctcgtgcgtcacgcccgaagtcctccgccccgtcggtccncgttctccgttccccgccctccgttcgccacgtaacgacgtggacggcgggcgtcggcgaacggg

SEQ ID NO: 328191 - DNA, 646 bp, Homo sapiens
  misc_feature: GZ8MTXP01D1JA5.15.1.A01.1.454.CMB.2.raw
  modified_base (270)..(270): a, c, t, g, unknown or other
  misc_feature (270)..(270): n is a, c, g, or t
  modified_base (534)..(534): a, c, t, g, unknown or other
  misc_feature (534)..(534): n is a, c, g, or t
  modified_base (601)..(601): a, c, t, g, unknown or other
  misc_feature (601)..(601): n is a, c, g, or t
  modified_base (633)..(633): a, c, t, g, unknown or other
  misc_feature (633)..(633): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagttggttggggttatctacctttgtcctcctacggtaaccaaccaccccgacccggcacgaccgaccccaaatcatagatttangacggaccaacgtaacgccgaccctgaaggtctttacgtaatcgtcttcctcgtcggacctccgaaagtcgtacggacaaaccgacccggtcccttccctacgaactaactccgtccggtcgggctaccgaggtcgtaacggaacgaaccggagtaacctttaaatttacttacgtgtctcgtctactaataagtagtaaaggttaataaactaacttataacgtagttacgggacgggaacgaacaggtcgtcgtaccgtcgngccgtcgacgacccgtaaggtcctccgtccccgtggtaactccgttcttcccgttccccgccttccnccgttacttacgtaacgactggacgcgggttntcggaacgaacgg

SEQ ID NO: 328192 - DNA, 594 bp, Homo sapiens
  misc_feature: GZ8MTXP01AXLY6.15.1.A01.1.454.CMB.2.raw
  modified_base (256)..(256): a, c, t, g, unknown or other
  misc_feature (256)..(256): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcacgacgccccaaactcatgatttangaggccactaagccaccctcgaggtctttactaatcgtcttctctcggctccaagtctggacaacacggcctcctgacatctccgtgggctcgngctaggacgngaggtacttaattacttacgtgtactcgcttanaatagtaggtaaacgttataaacacttatacgttagttcgggacgggaagggaacccaaggtcgtacgacccgtcgtacgcgtacacgacccgaggtccctccgccccgttcgcctacgttccttaccgttcccctaccctccgttacgttcccgttacggtaagtacgtcgggacggcgggttccgtgggaacgtaacgg

SEQ ID NO: 328193 - DNA, 631 bp, Homo sapiens
  misc_feature: GZ8MTXP01CLNQI.15.1.A01.1.454.CMB.2.raw
  modified_base (266)..(266): a, c, t, g, unknown or other
  misc_feature (266)..(266): n is a, c, g, or t
  modified_base (581)..(581): a, c, t, g, unknown or other
  misc_feature (581)..(581): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagttggttggggttatctaccttgtcctccgtacggtaaccaaccacccgaccccggcacgaccaccccaatcatgtattngcgaccacacgcaccctgaggtcttactactcgtcttctcgtcgcctacgtaagtctaggtaccaaccgccggtcctaccgagaactactccgtccggtggtcctcgagcgtaacgacgcggtagtaaccttaaagtttactacgtgctctactactaattacgtaagtaagttaaactaactaacttaagtaacgtacggttacgggacggaacgggaaccagggcgtacgtaccgtcgtcgaccgtcgaccgaccgacgtccctaccgccccgtcgtccctacgttcccgttcccgttccccgtcccgttccnccgttccgttacggtaacgacgtcgggcggtcggcggtaacggcgaacgg

SEQ ID NO: 328194 - DNA, 581 bp, Homo sapiens
  misc_feature: GZ8MTXP01CSZ06.15.1.A01.1.454.CMB.2.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctgtaccaacaccacccgnagacgaccccaatcatgattangagccacagcgaccctgaggtctttactaatcgtcttctcgtcgcctaccaagtctggaccaacgccggcctccctagactaatcgtccgtggctcgaggctaagacgngagtacttaaattactacgtgctgctacaatatagtaagttanaaactactatacgtagttcggacggaacgggacaggctacgtaccgtcgtgccgtcgacgacccgacgtccgtcccgtccccgtcggtaacctaccgttccttcccgttccccgtccccttcgttccgttcgttaccgtaacgacgttcggacggtccgggttacgtcggaaccgaaggg

SEQ ID NO: 328195 - DNA, 587 bp, Homo sapiens
  misc_feature: GZ8MTXP01EQC1H.15.1.A01.1.454.CMB.2.raw
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaatcatgatttatgaggccacaagcgaccctcagggtctttctaatcgcttctctggctcaagtctggcaacncggcctcctgacatctccnggctcgagctagacgngagctaattatactgctgctcatatgtaagttaataaactacttaatactagttacgggacggaaggggaacccaaaggggctacggtacccgttcccgtgccgtccgacggaccccgaacggtccgtcccgtaccccccgtcggtcctaccgttcccgttcccgttcccccgccccttcccgttaccggttccttaccggtaacgacgtggacgggcgggcgtcgggaacgaaccggg

SEQ ID NO: 328196 - DNA, 754 bp, Homo sapiens
  misc_feature: GZ8MTXP01B2D1P.15.1.A01.1.454.CMB.2.raw
  modified_base (264)..(264): a, c, t, g, unknown or other
  misc_feature (264)..(264): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcaccttgtctcctggtaccaacacccgaccccggcacgaccgacccccaaactcatgattttanggacggccactaagccgaccctcgagggtcttttactaatccgtcttcgtcgtcggctaccctaaaggttctacgggaccaaaccgtaccggccccttaccctagtaacctaaacgttccgtcccgttcgggggaccttcccggaaacgggtccttaacgggaaaccggaaccggaacgggttaaacctttaaacgttttaactttaaccgttcggtaccttcgtccttaaccgaatttaaacgttaggttaaaacggttttaaactaaaaccgtaaactttaaacgtttaaccgttaacgtttaccggggaaccggggttaaagggacccccggaaaggggttcccgtaccgggttaacccgtccgttacggccgttacccgacgacccgaacgtccgtcccgtcccccgtcggtccctacttccgttccttccccaccccgttcttccgacttacgtaacgcgtggacggcgcgtcggaacgaaccgg

SEQ ID NO: 328197 - DNA, 671 bp, Homo sapiens
  misc_feature: GZ8MTXP01C5621.15.1.A01.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (569)..(569): a, c, t, g, unknown or other
  misc_feature (569)..(569): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctggtctcctggacagtcgatcaccatctcctgcactggaaccagcagtgagtggttggggttatcacttgtctctggtaccaaccacccacccggnagacgaccccaatcatgatttangagccanacgcgaccctgacggtcttactaatcgtcttctcgtggctccgaagtcgtaggaccaaccgtaccggccttaccctagaacctatccgtccgtacgggctcgaggtctaacggacgaacggagtactttaaagttagtaccgtcgactgaccttagaattataggtaaagtttaacaaacgtacttattaacgtagttaccgggacgggaaacggtacccgtaaggtccgttacggtaacccgttccgtacggtccgtaccgacggtacccccgaaggtcccctcccggtccccccgttggttaacccnccctttccgtccccgggtttccccctaccccgttcccgttacccggttcgttaaccggtaagtacgtcggggacggccggggacttcgggaaccgtaacggg

SEQ ID NO: 328198 - DNA, 573 bp, Homo sapiens
  misc_feature: GZ8MTXP01AIYID.15.1.A01.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (566)..(568): a, c, t, g, unknown or other
  misc_feature (566)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattggagaacacgtgattcttaatntgaactagcctgagagccgatgacacggctgtgtattcngtgcgagagacggtataagtgttactggttgccacgtcggggaccaggggaaccctggtccaaagtccgtctcgtcagcccctacgaccgaacgggtccccacgtccgtcccttcccccgtcggcccaccctccctaccaacgacgcctaccgtcgtcggggcaacggcgccggcccgtcgggcctcggccgtgggtaccaaacggtccgttaccgtcccgcgtaacggtacgttactcggagtcgggcgcggaccgagggtccgngtaagngnnngngng

SEQ ID NO: 328199 - DNA, 657 bp, Homo sapiens
  misc_feature: GZ8MTXP01C7RTC.15.1.A01.1.454.CMB.2.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctacttgtctctacggtaccaaccaccgacccgcacgacgaccccaaatcatgtattangacgcanacgcgacctgacggtctttactatcgtcttctcgtcggctaccaagtcgtcggacaaccgaccggtcctcctagaactatccgtaccgtcgggctccgaggtccgtaacgggaacgaacggtacggtaacttaaacgtttacttacgtcgtctcgtctactataagtagtaagttaactaaacacttatacgtagtacgggacggaacgaactaacgggtcgtcgtaaccgtcgcgtccgaccgaccgacccgtacggtcccgtcccggtccccgtccggttccctaccggttccctaccccgtttacccccgaccccgtttcccttaccgggttacttaaccggtaacgtaacggtcgggaccgggtcgggcgtaacgggaacgtaacggg

SEQ ID NO: 328200 - DNA, 672 bp, Homo sapiens
  misc_feature: GZ8MTXP01CQ4F2.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaaccacccaccccggcacgaccgacccccaaactcatgtatttatgacggccaacgtaacgccgacccctcgagggtctttactaattccgtctttctcgtcggtcctaccaagtcgtggaccaaccgaccggtccctcctgaacctattccgtaccgtgggcctcgaggcgtaggaccgaacggacggtacttaaatttactacgtgtactcgtactactattaagtaggtaaacggttaactaaactaacttattaacgttagttacggggacgggtacgggtaaccaacgggtcgtacggtaacccgttccgtcggccgtacgaccggacccgtaacggtcccgtacccgtcccccgttcggtccctaccttcccttccgttaccccctacccgtcccgttccgttaccgttacggtaacgacgtggacggtcgggacgtcggaacggaacgg

SEQ ID NO: 328201 - DNA, 575 bp, Homo sapiens
  misc_feature: GZ8MTXP01BESF0.15.1.A01.1.454.CMB.2.raw
  modified_base (255)..(255): a, c, t, g, unknown or other
  misc_feature (255)..(255): n is a, c, g, or t
  modified_base (436)..(436): a, c, t, g, unknown or other
  misc_feature (436)..(436): n is a, c, g, or t
  modified_base (481)..(481): a, c, t, g, unknown or other
  misc_feature (481)..(481): n is a, c, g, or t
  modified_base (549)..(549): a, c, t, g, unknown or other
  misc_feature (549)..(549): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggcacgacgaccccaaatcatgtatttagngacggccactaacgcgaccctgtacggtcttctaacgtcgtctttctcgtcggctaccgtaagtctacgggacaaccgaccggtccctccctagactaactcgtccgtcgggacctcgacggctaacggacgaacgagtacctaaattcttacgtgtctcgctatatagtacgtaagttanaactacttatacgtagtcggacggaggacgaggctcgtaccgtcncgcgtcgacgcccagtcctcgccccgtggctacttcgtccttcccaccctcttcgcttacgaacgtancggtaggccggttcgtcggcgaacgg

SEQ ID NO: 328202 - DNA, 612 bp, Homo sapiens
  misc_feature: GZ8MTXP01A0IUF.15.1.A01.1.454.CMB.2.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (604)..(604): a, c, t, g, unknown or other
  misc_feature (604)..(604): n is a, c, g, or t
  modified_base (606)..(608): a, c, t, g, unknown or other
  misc_feature (606)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgngaagggcagattcacatctcagagacaattgganaacacgtgattctaatatgaacngccngagngccgatcgacgacggcttgtgtatttctgtgcgaaggagtacgggttaataaagttaggttacgttgggtttcggccgtacggttcgggggccgaaggggtaacccctgggtcaacgttccgtcgtccgtacacggcccctaccgaaccgaaacgggcccctacgtccgtcccttcccccgtcggccctacccctccctaccgaacgaccgccgtaccgtcggtcgggggcaacgggccggccggcccgtgggcctcgccgtggaccaacggtaccttaccgtcccgctaacgtaacgcgtacggcgggtcgggtcgcgggccgaacgggccagaacggngnnngngn

SEQ ID NO: 328203 - DNA, 710 bp, Homo sapiens
  misc_feature: GZ8MTXP01BZJHH.15.1.A01.1.454.CMB.2.raw
  modified_base (272)..(272): a, c, t, g, unknown or other
  misc_feature (272)..(272): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagttggttggggttatctaccttgtctccgtacggtaacccaaccacccgacccggcacgaccgacccccaaactcatgtatttagnggacggaccaacgtaacgccgaccctcgaggtctttactaactcgtcttctcgtcgcctacgtaagtcgtcggaccaaccgacccggtcctacctagactactccgtcccgtcgggcctcgaggcgtaacgacgaacgtagtacttaattacgttactgtctgtcctagtaattagtaaggtaaagttaataaactacttaagtacgttacggtaccggggaacgggtaacgggaacctaacggggtccgttaaccggtacccggttccgtacggtaccgtacccgaaccggtaaccccggtaccggtccccgtaccccggtcccccgttcccggtaaccttacccgtttcccgtccccgttacccccgtacccttcccgttaccggttccgttacggtaagtaccgtcgggacgggtccggacgtcggaacgtaacg

SEQ ID NO: 328204 - DNA, 701 bp, Homo sapiens
  misc_feature: GZ8MTXP01A7OIO.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagtggttggggttatctaccttgtctccgtacggtaaccaaccacccgacccggcacgaccgacccccaaatcatcgtatttagtggacggaccaacgtaacgccgtacccgtcgtagggtcctttactaacgtccgtctttcgtcgtcggtctaccgtaagtctcggacaaccgcgtccctcctagactatcgtccgtcggcctcgaggcgtacgaacgaacgtacggtacttaagttacttacgtcgctcgtacctataagtacgtaggtaaacgttaactaaacgtaacttaagttacgttacggttacgggacgggtaacggaccgtaggtcgttacgacccgtcgtacgccgtacgaccgtaccgacgtcccgtacccgtccccgttcggtaacctaccgttccgttccccgttccccgtaaccccgttccgttacccggttacgttaccgggtaacgtccgggttcgggaaccggggtccgggttacggtaacgggaaccggtaaccggg

SEQ ID NO: 328205 - DNA, 576 bp, Homo sapiens
  misc_feature: GZ8MTXP01AJ0FO.15.1.A01.1.454.CMB.2.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (558)..(558): a, c, t, g, unknown or other
  misc_feature (558)..(558): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaaccaccaccccggnacgacgacccccaaatcatgattttacgngacgcacgacgccgacctgacggtcttactatcgtcttctcgtcgctacgagtcgcgaccacgccgtcctacctagactagtcgtccgtcggctcgcgcgtaagacgtaacgagtacttaattctcgtcgctcgtctatagtagtaagtaagttaactaactactattacgtacggtcgggacggacgacgacggtcgtcgtccgtcgtcgtcgcgaccgtaccgacggtccgtccgtccccgtcgtaacctcttccgttcccgttacccgtcccgtcgttccgcgttacgcgtcgnggcggcggcgtgcgaacg

SEQ ID NO: 328206 - DNA, 627 bp, Homo sapiens
  misc_feature: GZ8MTXP01AZTTW.15.1.A01.1.454.CMB.2.raw
  modified_base (228)..(228): a, c, t, g, unknown or other
  misc_feature (228)..(228): n is a, c, g, or t
  modified_base (396)..(396): a, c, t, g, unknown or other
  misc_feature (396)..(396): n is a, c, g, or t
  modified_base (453)..(453): a, c, t, g, unknown or other
  misc_feature (453)..(453): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggnagacgccccaaatcatgattatgaggccataacgcgaccctgaggtctttacgtaatcgtctttctctggctaccagtctcggcaaacgccggtccctcctagacaactctccgtcgggcttccgagggtccaagaccgaacgagggtaccttaaattattactgctnctactatatagtaacgttataaacattatataagttcggacgggagggacaaggtcncgtccgtcctggacgtcgacgacccgtaacgggtcctcccggtcccccgttcggtaaaccctcccgttcccgtttacccgttccccccgtacccccgtttccccgttccgttccgttacggtaacggtacggtaacgggtacgggtccgggaccggtaacgggaacggtaacgg

SEQ ID NO: 328207 - DNA, 593 bp, Homo sapiens
  misc_feature: GZ8MTXP01CLU5C.15.1.A01.1.454.CMB.2.raw
  modified_base (224)..(224): a, c, t, g, unknown or other
  misc_feature (224)..(224): n is a, c, g, or t
  modified_base (312)..(312): a, c, t, g, unknown or other
  misc_feature (312)..(312): n is a, c, g, or t
  modified_base (427)..(427): a, c, t, g, unknown or other
  misc_feature (427)..(427): n is a, c, g, or t
  modified_base (559)..(559): a, c, t, g, unknown or other
  misc_feature (559)..(559): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(590): a, c, t, g, unknown or other
  misc_feature (587)..(590): n is a, c, g, or t
  modified_base (592)..(593): a, c, t, g, unknown or other
  misc_feature (592)..(593): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccgagggcaggggctagagtggctctcaatgatttacaccgagtggggacggtggaccacatactacgcagattccgtagaaggcagattcacatctcaganaactaagttggaagaacacgtagtattacttaatatacgaacaagccctagaggacgccgagtacgacgacggcttgtgttatttcgngtgacgaaggaggtaacggttaattaagtagtttacgtggtttacggaccgtacggtcccggggaccgaacgggtaacccgtggtactaaacgtcgtcgtccgtacaccgtaccnccgaacgaacggcccactccgtcctccccgtcgcctaccctcctacacgacgtccacctcggtcgggacacgggcgccggtccgcggtccgcgcgtcggtacgacgtacctaccgtccgacgttcgaacggngacggcgtacgcgaccgaggccngangnnnngnn

SEQ ID NO: 328208 - DNA, 629 bp, Homo sapiens
  misc_feature: GZ8MTXP01B90BM.15.1.A01.1.454.CMB.2.raw
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccacccggcagacgccccaaactcattgatttangacggccactaacgcgaccctcgagggtctttcaatcgtcttctctcgctccaagtcnggtaccaaccgacggtccctccctgaactactctccgtcgggctccgaggctaacgacgcggagtacctaatttactactgctgctacattagtacggtaagttaactaacacttaattacgtacgttcggggacggaacggaacccaacgggtcgtacgtaccccgttcgtcggcccgtacgaccgtaccccgaaggtccctccccggtccccgtcgggtcctaccgtttccgttcccggttaccccgttccccgtccgttaccgccttaccggtaacgccgtgggaccggcggggttactcggggctaacgggg

SEQ ID NO: 328209 - DNA, 531 bp, Homo sapiens
  misc_feature: GZ8MTXP01B6UHY.15.1.A01.1.454.CMB.2.raw
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaatcatgatttatgaggccactaagcgaccctcagggctttctaatcgctttctctggctccaagtctggcaacacggcctccctgacatctccngggctccgaggctaggacgcgaggtcttaattattactgctgctnatatgaagttataacactatactagttcgnggtaggaccaagggctaggacccgtacctgccgtcgacgacccaaggtcctcgccccctcggtcctacttctcgttcccaccctccttcgttcttacgtgctgcgcgggcgtcggcgaagg

SEQ ID NO: 328210 - DNA, 636 bp, Homo sapiens
  misc_feature: GZ8MTXP01EAIMU.15.1.A01.1.454.CMB.2.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggnacgacgcccccaaatcatgatttangaggccactaagcgaccctcgaggtctttctaatcgtcttctctcggctaccaagtctaggacaactacggcctccgtagacaatctccgtggctcgagctacgaacgcgagtaaccttaaattcttacgtgctgcctacatagtagtaaggttaataaactacttaatacgttagttaccggggacgggtaacgggaacccgaaacgggtccgttacggaaccccgttccgtacgtccgtaccgaacgtacccccgaaacgggtccttcccggtccccccttcggggtaaccctacccgtttccgttcccgttccccgtccccttaccgttccgttccttaccgtaagtacttcggacggcgggcgtcgggcgaacggg

SEQ ID NO: 328211 - DNA, 557 bp, Homo sapiens
  misc_feature: GZ8MTXP01B203L.15.1.A01.1.454.CMB.2.raw
  modified_base (385)..(385): a, c, t, g, unknown or other
  misc_feature (385)..(385): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgggggggtccctgagactctcatgtgcaggctctggattcagcgtcaggaatagttacatgagttgggtccgccaggctcagggcagggggctaggagtggctctcaatgatttacaccgagtcgggggacggtgggacccacataactacgcagattccgngaggcagattcacatctcagagacatttggagaacaccgtgattacttaatagtcaacagcctgaacggngacccggatgaacnccggctggtcgttatttcgttggtgcgagttaggacggggttaataagtaaggtttacgtgggtttgggtcccgttaacggtcggggg

SEQ ID NO: 328212 - DNA, 576 bp, Homo sapiens
  misc_feature: GZ8MTXP01EBAU6.15.1.A01.1.454.CMB.2.raw
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggttatcacttgtctcctgtaccaacaccacccggcacgacgccccaaatcatgatttangagcacaagcgacctnaggtctttcaatcgctttctctgctccaagtctaggcaacacggcctcctgacatctccgtggctccgaggcctacgaacgtcggagtcttaaagttattacngctgcctanaattagtagtaaaggtttaataaactaacttaattacgttagttcgggacggaaggggaacccaaggggtctcggaaccttccgtagccgtccgacgaaccccgaagtccgtccgtcccccgtgggtcctacttctcccgtttccccgacccttccttacgttcgttaccgtgactgacgggcggactcgggcaaggg

SEQ ID NO: 328213 - DNA, 823 bp, Homo sapiens
  misc_feature: GZ8MTXP01A9SVA.15.1.A01.1.454.CMB.2.raw
  modified_base (257)..(257): a, c, t, g, unknown or other
  misc_feature (257)..(257): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctacttgtctccgtcggtaccaacacccacccggcacgacgaccccaatcatgattangagccactaagcgacctgacggtctttctaatcgtcttctcgtcggctaccaagtcgtcggaccaacccgtacccggtccctacccgtagaactaacgttccgtaccggttcgggggtccttaccggaacgggtccgttaaacgggaacccggtaacgggtaaacgggttacctttaaaattttacgtttaaccgttcgggtactttcggtaccctttacgtaaatttaacggttaaaggttaaaacgggtttaaacttaaaacccgtaactttaaacgtttaaccggtttacgggttaaccggggggaacgggtaaaccggggaacccgtaacgggggttacccgttacccggggtaaccccgttccgtttaaccgggcccgttacccgaaccggtaccccggtaaccgggtccccgttaccccggtcccccgttacgggtaacccttcccgttccgtttccccggttcccccggtaccccttccgttccggttaccgttaacccgggtaaggtccggttaacgggaccgggtccggggttacgtaacggggaacgtaaccgggg

SEQ ID NO: 328214 - DNA, 712 bp, Homo sapiens
  misc_feature: GZ8MTXP01B641S.15.1.A01.1.454.CMB.2.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctaccttgtccttccgtacggtaaccaaccacccacccggcacgaccgaccccaatcatgtattangagacagacgcgtacctgtacttctatcgtcttctctgcnctagtcngacacacgctccagacactntcgtcggcgtacgacggcgtacgaacgaacgtgtacttaaactttaattactacgcgttagtacttactaagttaacgttaagggtaaacgtttaaactaaacgttaactttaacgttaaacgttaccgggtttacgggaaccggggtaacgggaaacccgtaacgttacggggtacccggttaaaccggttacccccggtggtacccgtaccgaacccgggtaccgtaaacccgggtccgttaaccccggtacccccgttcccggttcctaacccgtttcccgttacccgttcccccgttacccttcccgtccgttaccgttacggttaacctaacggttcggaacggttcccgggacgttcggtaacgaacggggtc

SEQ ID NO: 328215 - DNA, 815 bp, Homo sapiens
  misc_feature: GZ8MTXP01CT8VJ.15.1.A01.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctcggtaccaacaccacccggnacgacgaccccaatcatgattangacgcactaacgccgaccctgacggtctttactaactcgtctttctcgtcggtcctaccgtaaacgttccgtacgggaccaaaccgtacccgggtccccttacccgtaggaaacctaaacttccgttccggtcgggggtcctccggaacggtaccgttaacgggaaaccggtaacgggtaaacgggttaacctttaaaacttttacgtttaaccgtcgggtaccttcggacctttaactaaagtttaaagtaagggtttaaaacgggtttaaacttaaaaccgttaactttaaacgttaaaccggttaacggtttacccgggggaaccggggtaaaccgggggaaacccctaaacggggtaccccgttaccgggttaaaccccgttccgtacggtaccccggttaccgacccggtaaccccggtaacggtccccgtaccccggtcccccgttaacgggtccctaccgttccgtttcccgttccccgtaccccttccgttaccgttccgtttaacggaacgtaccgttcgggaccggcggggttacgtcgggaacgaacgggg

SEQ ID NO: 328216 - DNA, 579 bp, Homo sapiens
  misc_feature: GZ8MTXP01ADHFV.15.1.A01.1.454.CMB.2.raw
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggagcttggtccaggccggggggtccctgagactctcatgtgcaggctcgtggattcagcgtcaggaatacgttacatgaggttgggtccgccaggctcgagggcgagggggctaggagtggctctcaagtgatttacaccggtagtcgggggacggtgggaccacagtaactacgcagtattccggtgaagggcagattcgacatcacagagactaattagganaacacgtnaattactaagtatagaaccaggtcctaggacgagaccgtagtgaaccgtacgggtntgtagttcgttcgnggtacgtacgaaggttacggttaacgggttaataagttaaggttacgtgggttacggcgttaacgggtcggg

SEQ ID NO: 328217 - DNA, 797 bp, Homo sapiens
  misc_feature: GZ8MTXP01B82AR.15.1.A01.1.454.CMB.2.raw
  modified_base (274)..(274): a, c, t, g, unknown or other
  misc_feature (274)..(274): n is a, c, g, or t
  modified_base (780)..(780): a, c, t, g, unknown or other
  misc_feature (780)..(780): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcaggtgtagttggttggggttatctaccttgtcctccgtacggtaaccaaccacccgacccggcaacgaccgacccccaaatcattagtatttanggacgaccaagtaacgccgaccctcgaggtcctttactaacctcgttctcgtcgtcggtacctacgtaacgttcgtcggaacctaacccgacccggtcccttacccgtagaaacctacgttccgtcccggtcggtcctacccggaaggtcctaaaggggaaaccccgaagggtaaacgttaaactttaaaacgtttaactttaccgtcggttacttacgaccctttaactaaaggtttaaacgtaaggttttaaaaacgggtttaaacttaaaaccgttaaactttaaacgttttaaccggttaacggttacccgggggaaccgggtaaacggggaaaccctacggggttacccgttaacggtccccgttaccgtacgccgttaccggaaccgaccccgtacgtcccgtaccccgtccccgttcggtaaccctcgtttcccttccccggttccccgtccccttccgccgttacttaaccgggaacgacgttaacgggcggcccggnggtaacggaacgaacgg

SEQ ID NO: 328218 - DNA, 695 bp, Homo sapiens
  misc_feature: GZ8MTXP01A9SOL.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctctcggtaccaacaccacccgcacgacgaccccaaactcatgtatttagtgacggaccaacaacgccgaccctcgacgggttctttctaatccgtctttctctcggctaccaagtcgtagccaaccgacccggtccccttacccctacgaacctaacgttccgtcccgtcgggggtcctacccgagggtccgttaaacgggaacgaacggtaaggtacccttaaagtttacgtttaacctggtctcgtactactaagttagtaggtaaagttaactaaactaaccttataacgtagttcggaggaacgggtaaccaacggggtcgtacggtaccgtccgtcgccgtaccgacgacccgtacggtccgtccgtcccccgttcggtccctccgttcccgtcccgttcccccgtaccccgttcccgttccgttccgtttaccggaacgttaccggaacggtcgggccggggcgtcgggaacgaaccggg

SEQ ID NO: 328219 - DNA, 593 bp, Homo sapiens
  misc_feature: GZ8MTXP01DGRQF.15.1.A01.1.454.CMB.2.raw
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctctggtaccaaacaccaccccggcacgacgcccccaaactcatgattatgaggccaacaaagcgaccctcgaggctttctaatcgcctttctctggcctacaagttctggccaacaccggcctccctagacaatctcctgggctccagctagacgngagctaaattntacctgctgntctatatagaaagttaataacataatactattcggaggaggaaccaaggctgaccgttccagcgtcacgacccgaagcccgtcgtcccccgtgggtaaccctaccttccgttcccgggtttccccccgtccccgttccccgttccgttccgttaacccggttaacgtccgtaacgggacgggtccggggttacgtcgggaacggaacggg

SEQ ID NO: 328220 - DNA, 704 bp, Homo sapiens
  misc_feature: GZ8MTXP01A02JR.15.1.A01.1.454.CMB.2.raw
  modified_base (251)..(251): a, c, t, g, unknown or other
  misc_feature (251)..(251): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctacttgtctctcgtaccaacaccacccgcacgacaccccaatcatgattangagcactagcgacctcgcggtctttcgtaatcgtcttctctcgctcctaagtctcggacaaccgaccggtccctaccctacgaactaactccgtaccggtcgggtacttacccgagggccgtaagggaaaccgaacggaagggtaccctttaaatttacgttacctcgtcgttacgtcccttataattaagtagttaaaggtttaactaaacgtacttaagttaaccgtaggttaccgggaacgggttaacgggaacccgaagggtcgtacggtaaccccgttccgtcggaccgtaccgaccggacccgtaacggtccctcccggtccccttccgggtcctacccgttcccggttacccgttaccccctccccgttcccgttaccgttccgttaaccggtaaggtaacccgttggggacccgggtcgggaccgttcgggaaccgtaaccgggg

SEQ ID NO: 328221 - DNA, 741 bp, Homo sapiens
  misc_feature: GZ8MTXP01D1XPH.15.1.A01.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcacttgtctctggtaccaacaccacccgnacgacgaccccaatcatgatttangacggccacaagcgaccctgagggtctttctaatcgtctttcctcgtcggtcctaccgtaagttcgtacggaccaaacccgtacccggtccccttacccgtacgaacctaacgttccgttccggtcggggtacctaccggacggtccgtaaacgggaaccggaacgggtaacggtaactttaaacgtttactttacgtcggtcttcgtacttactaagttaagtaacggttaaagtttaactaaactacttaagttacgttaacggttaccggggacgggaaacggtacccgtaagggtccgttaccggtaacccgttccgtacggttccgaccgtaaccggaaccccgtaacggtccccgttacccgtcccccggtccggtaacctcccgttccgttccccggttcccctcccgttcccgttacccgttccgttaaccgtaaggtccggttaacggccgggcgggttcgtaacgggaacgaaccggg

SEQ ID NO: 328222 - DNA, 654 bp, Homo sapiens
  misc_feature: GZ8MTXP01BV7RS.15.1.A01.1.454.CMB.2.raw
  modified_base (373)..(373): a, c, t, g, unknown or other
  misc_feature (373)..(373): n is a, c, g, or t
  modified_base (641)..(641): a, c, t, g, unknown or other
  misc_feature (641)..(641): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttgggggttatctaccgttgtcctcctacggtaaccaaccaccccgaccccggcacgaccgacccccaaatcatgatttagtgacggccacgtaacgccgaccctcgaggtctttactactcgcttctctcggctccaagtcgtcggacaaccgaccgccctcctagacatctccgtggctcgnggctacgacgaacggtagtacttaaatttacttcgtcgtctcgtcctagtactagtaagtaacggtttaactaaactacttaattacgtaggttacgggacgggaacgggaccgaacgggtcgtccggtaaccgttccgtcggtccgtcccgacgacccgtacggtcccgtcccgtcccccgttcggtaaccctcccgtttccgttacccgttcccgtccccttccgttcgttcgttacgtaacgtacgtcggacgggcgggttacgngggaacgaacggg

SEQ ID NO: 328223 - DNA, 612 bp, Homo sapiens
  misc_feature: GZ8MTXP01EUUWM.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctgtaccaacacccaccccggcagacgaccccaaactcatgattatgagccacagccgaccctcgaggtctttctaatcgtcttctctcggctccaagtctggaccaaccgacggtccctccctgaactaatctcctgggctcgaggctaagacgaagaggtacttaaagttacttacctgactgctacatagtagtaaagttataaactacttatacgtagtcgggacggaacggacaggctacgaccgtcgtcgccgtacgacgacccgacggcctcccgtccccgtcggtccctaccgttcccgttcccgttcccccgtccccgttccccgttccgttccgttaaccggtaacgtccggttcgggacgggccggggttacgtaacgggaaccgaacgggg

SEQ ID NO: 328224 - DNA, 715 bp, Homo sapiens
  misc_feature: GZ8MTXP01DHQWI.15.1.A01.1.454.CMB.2.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
tcagtctacgtagccacgaccggtgctcgatttagacgtctcatcagggcctggggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcacttgtctctggtaaccaacaccacccgnacgacaccccaaatcatgattangacgcacgaancgaccctntaggtcttcaatcgtcttcgtctgctactaagtctaggcaacacggcctccgtanactatcgtccgtcggtctcgacgtcgtaaacggaacgtaacggtaacgtaacttaaatttacgtacgtcgtcgtacgtactacgtaagtaagttaacggttaaacgtttaaactaaacgttaacgttaacgttaacgttacgggtaccgggtaacgggaacgggtaaaccgtaacggggttacgtaccggtacccggttccgtacggtacccgtacgaacccggtacccggtaaccggtcccgttaccccggtacccccgttaccggtaacccttacccgttcccgttccccggttaccccgtccccggttacccgttacccggttacgttaaccggtaacggtacgtaacgggcgggtccggttacgtaacgggaaccggtaacgg

SEQ ID NO: 328225 - DNA, 830 bp, Homo sapiens
  misc_feature: GZ8MTXP01ABYM3.15.1.A01.1.454.CMB.2.raw
  modified_base (178)..(178): a, c, t, g, unknown or other
  misc_feature (178)..(178): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (485)..(485): a, c, t, g, unknown or other
  misc_feature (485)..(485): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccngcagtgagtgtggggttatcacttgtctcctggtaccaacaccacccggnacgacgccccaaatcatgattangaggccactagccgacctcgtaggtctttacaatccgtctttcgtaccgtcggtcctaccgtaagttcgtacgggaccaaaccgcccgggtacccttcccctaggaaccctaacgtccgttcccggtcggggtacctacccggaacggtccgttaaacgggaaccggtaaccggtaagggtttacccttaaaaagttttccgtaaccgtttcgggacctttcgggtaacccttnttaaaccgttaaggtttaaccggtaaaacgggttttaacttaaaacccggtacctttaaagtttaaccccggtttaagggttaccccggggtaaacgggtaaacgggggaacccctaaacgggggttaccgttacccgggtaaaccccggttaccgttcggtaacccggtcccgaaacgttacccccggaaaggtccccgttacccggtcccccccgttagggtaacccttaaccgttcccgtttacccggttaccccgtaacccgtcccggtttaccggaccttacggttaaccgcggtttaacggccgggtccgggttacgttaaccggggaacgtaaccggg

SEQ ID NO: 328226 - DNA, 689 bp, Homo sapiens
  misc_feature: GZ8MTXP01AGXI1.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccacagcgaccctcgaggtctttctaatcgtcttctctcgctccaagttctggcaacacggcctcctgacaatctcgtacgggctccgaggctacggacgtaacggaagaccttaaatttattacgtggcttagcttctaataagttaggtaaagtttaacttaaacctaacttaacttaacgttagttacggggacgggtaacggggaacccgaaacggggcgttacggtaaccccggttccgttcgcccggttacgaaccggaccccggtaaacggtcccgttccccggtccccccgttccggttaacccgaaccccttttcccgttccccggtttacccccctaccccgttccccttaccggttcccgttaaccgtaacgtaacggttcgaacggggccgggttcccgtaagggcccgtaaaggggg

SEQ ID NO: 328227 - DNA, 700 bp, Homo sapiens
  misc_feature: GZ8MTXP01CEMOI.15.1.A01.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
  modified_base (470)..(470): a, c, t, g, unknown or other
  misc_feature (470)..(470): n is a, c, g, or t
  modified_base (693)..(693): a, c, t, g, unknown or other
  misc_feature (693)..(693): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
tcagtctacgtagccacgaccggtgctcgatttagacgtctcatcagggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccggtaggaagggcagattcaccatctaccagagactaattgganaacacgtgtattactaatatagaacagcctgagacgaccgatgacacggtctaggtnttatttcgtgtggacggaaggtaggtaacgggtaattaaagtacggtttacgttgggtttacggaccctacgggtacccggggaccgtacggggtaaccccgtggtactacgttccgtctccgtacncgtcctacccgaccgaacggtccctagtcccgttcccctccccncggaccctacccctaccgtaccaaaggtccgccgacccgttcgggacggggcccaaccgggcggggtccccggtccccgggttgggccccgtttcccggaacccggttacggggtaaccctaaacgggtacccgtttacccgttaccccggtaccggttaaacggttacgcgacgggttaccgggccgggtacttacggggaccaacgggggccacgtgacgngcngngn

SEQ ID NO: 328228 - DNA, 711 bp, Homo sapiens
  misc_feature: GZ8MTXP01ENXM1.15.1.A01.1.454.CMB.2.raw
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctaccttgtcctccgtacggtaaccaaccacccgaccccggacacgaccgacccccaaatcatgatttagngacggccaactaacgccgaccctgaacggttctttactaatccgtctttcncgtcggtctcgaagtctcggaccaacgtaccggccctccgttagaacctaacttccgttcccgttcggggacctccgaacgggtccgtaacgggaaaccggaacggtacgggtaacctttaaagtttacttaacccgtggcttcgtacttactaagttaacgtaaggttaaaaggttaacttaaaaccgtaaacgttttaataaccgttaacggttaccggggaacgggtaaacgggtaaccccgaaggggtccttacgggtacccgttccgtagtccgtcgacggtacccgtacggtcccgtccgtccccgtcgtcctaccgttccttccttccccgtaccctcgttccgcgttaactggtacgtcggacggcggcgtcgcgtaacgg

SEQ ID NO: 328229 - DNA, 646 bp, Homo sapiens
  misc_feature: GZ8MTXP01BL4G8.15.1.A01.1.454.CMB.2.raw
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (492)..(492): a, c, t, g, unknown or other
  misc_feature (492)..(492): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggagtcgtggggagcttggtccgagggtccggggggtcctgacgactctcatgtcgcagtctntggattcagtcgtanaaggaatagttacagtgaggttcgggtcccgccgaggcctccgaggggtccgagggggtctaggagtcggactctacgaatgtaacttaccgaccggtaggtcgggggacggtacggaccaacagttaaaccacgctagtacgttcgagaacgggctaagtacttccaactactcacgagagaactaagttgaacgtaacacgtatattacttaaanagtacgaactacgccgtaagaggacgaccgtaagtcgaaccctagggtccttaaggttagtttacttcgttgtacggaacggaaggttaggttaaccgggttaattaagttcggttaacggtggttaccggaaccggttaacggtaaccggggg

SEQ ID NO: 328230 - DNA, 829 bp, Homo sapiens
  misc_feature: GZ8MTXP01D91R9.15.1.A01.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcacttgtctctgtaccaacaccacccggnacgacgaccccaaatcatgattangacgcacgaagccgaccctgacggtctttactaactccgtctttctcgtcggccttaccgaaggtcgtacgggaccaacccgtccggccccttaccgtacgaacctacttccgtccggtacgggtcctccgaggccgtaacggaaccgtaacggtaacggtaactttaaactttacgttacgtcgtcgttactaccctagtaaagttaaggtaaaggtttaaaacggtttaaacttaaaacccgttaactttaacgtttaaccggttaacgggttaccggggaaccgggggaaaccgggtaaaccccgtaaacggggttccggttaacccggtaaccccggtttccgtacggtaccccgttaccgaacccggtaaccccggttaaaggggcccccgtttaaccccggtccccccgggttcgggttaacccttaccccttttccccgggttccccgttttaaccccccccgtaccccgtttacccgttacccggttaccggttaaccgggtaaccggttacggtccgggggtacccggggtaccggggttaccggtaaccggggaacccggtaacgg

SEQ ID NO: 328231 - DNA, 669 bp, Homo sapiens
  misc_feature: GZ8MTXP01CIIT1.15.1.A01.1.454.CMB.2.raw
  modified_base (250)..(250): a, c, t, g, unknown or other
  misc_feature (250)..(250): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggtatcacttgtctctggtaccaacaccacccggcagacgccccaactcatgattangaggccactaacgccgaccctcgaggtctttctaatcgtcttctctcggctaccgaagtctcgggaccaaccgacccggcccttacccgtagaaccaacttccgtacccgtcggggtacctcccgaggtcctacggaaccggaacggtaggtacttaaattattaccgtgtctgctacagttaagtagtaaaggttataaaccacttataacgttacgttacggggacgggtaacggggaccaacggggtccgttacggtacccgttcccgtcggccgttacccgacggtaccccgaacgggtcccttcccggtccccccgtggtccctaccgtttccgttccccgttccccgtccccttccgttccgttccgttacggttaacgcgtcgggacggtcggggccgtaacggcgaacggg

SEQ ID NO: 328232 - DNA, 570 bp, Homo sapiens
  misc_feature: GZ8MTXP01A7V4K.15.1.A01.1.454.CMB.2.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatctaccttgtctcctaggtaaccaaccacccaccccggcaacgaccgacccccaaatcatgtatttangacgccanacgcgaccctgaggtctttctaatcgtctttctctcggctccaagtctggacaacncggcctccagacatctccgtgggctcgagctagacgngagtacttaatcttacncgctgctnatagtagtaagttataactactatacgtagttcgggacgaagggacctaacggctacggacctcgtagccgtacgacgacccgacgtccctccgccccctggtcctccgttccttcccggttcccncccgtccncgttccttacggtaacgcgtaaggcggtcggccgtaaggcgaacg

SEQ ID NO: 328233 - DNA, 592 bp, Homo sapiens
  misc_feature: GZ8MTXP01A8CSO.15.1.A01.1.454.CMB.2.raw
  modified_base (381)..(381): a, c, t, g, unknown or other
  misc_feature (381)..(381): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (512)..(512): a, c, t, g, unknown or other
  misc_feature (512)..(512): n is a, c, g, or t
  modified_base (529)..(529): a, c, t, g, unknown or other
  misc_feature (529)..(529): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagggcccgggggggtccctggagactctcatgtgcaggctcgtggtattcgagcgtcaggtaatagtacagtgagttggtccgcaggctccgagggcgaggggctaggagtcggctctacaatgtaactttacgaccgtagtcgggggacggtagggacccanataaactacgcagacttccggagaagggcagtattcacatcacagagaactaagttcggaanaacncgtagtactttacttaaagactagaaacctagcctaggagtacgaccgaagtcgaaacgtccggnttaaggtcttagtttcnggtcgacgaagttggaacgggttaataaggttcgttacgtgggttacgcaacggttccggggg

SEQ ID NO: 328234 - DNA, 719 bp, Homo sapiens
  misc_feature: GZ8MTXP01CN28O.15.1.A01.1.454.CMB.2.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (432)..(432): a, c, t, g, unknown or other
  misc_feature (432)..(432): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtcagtgtgaggtgcagctggtggaggtcgtggggggaggtcttgggtccgagggcccggggggtcctgagactctcatgtgcaggctcgtggtattcgagcgtcaaggtaatagttacatgagtggtccncgaggctccgaggcagggctaaggngtcgctcactaagtgtacttacgacgtaggtaccggggacggtacgaccatacgtaaaccgacgcgtaagtacgttaccggaggaacggcagtacttaccacgtntaccgtacgaagtaagtaacgttaacgttacggaaactaaccgtacgttagtaactttaacttaaagtaacgtaacggaacgtacgtaccgtaggaacggaccggtacccgtaagtaccgggaaccgttacgggttcgttaagggtttaacgtttacgtttcggttgggtaacgtaacgggttaaagggttaacgggttaaaacgggttttaaagttaaaggtttccgggtttaacgggtttccggggttacccgggtaacccgggttaaccgggggtaaccggggg

SEQ ID NO: 328235 - DNA, 646 bp, Homo sapiens
  misc_feature: GZ8MTXP01BYT5A.15.1.A01.1.454.CMB.2.raw
  modified_base (233)..(233): a, c, t, g, unknown or other
  misc_feature (233)..(233): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctcctggtaccaacacccacccggnacgacgacccccaaatcatgatttagtgacggccaactaacgccgaaccctcgaagggtcctttactaactcgtctttctcgtcggcctccaagtcgtcggacctaaccgccggtaccctccctagaactaacttctcgtcgggctcgaggctagacgaacgaggtaccttaattacttactgtcngtcctanatagtagtaagttaataaactataatacgtacgttcgggacggtagggacctaacggggctacggacccgtcgtcgccgtccgacggacccgaggtccctaccggtcccccgttcggtaaccctccttccggttacccgttcccccaaaccccgttcccttaccgggttccttacggtaacgacgttcgggcgggccggttcgtcggggaaccaacgggg

SEQ ID NO: 328236 - DNA, 699 bp, Homo sapiens
  misc_feature: GZ8MTXP01DTPNE.15.1.A01.1.454.CMB.2.raw
  modified_base (672)..(672): a, c, t, g, unknown or other
  misc_feature (672)..(672): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
  modified_base (693)..(695): a, c, t, g, unknown or other
  misc_feature (693)..(695): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccgtgaaggcagattcaccatcctccagagacaatttggaagaacaccgtgtattacttaatatagaacagccagaagacgccgaatcgacacggtctgttagttatttcgtagtcgacggaaggtaggtaacggttaattaagttacggtttacgttgggtttacgccgtacggtcgggggaccgtacggggacccgttgggtacctagttacccgtcgttccgtaccgacgtcccctacccgaaccggacgggtacccctaccgttccgggttcccccttccccgtcggtaccccttaccccgtacccctaaccgaacgtacccgaccgtacccgtcgggtacggggaccaccggggacgggtccccggtaccggtccgggtccgtcggtcccgtacggtaccgtaaccggtacccgttaacccgttcccggtacgtaacggttaggttacccggtgggaccggtacgggtcgnggacggacgnggtacngacgnnngngn

SEQ ID NO: 328237 - DNA, 856 bp, Homo sapiens
  misc_feature: GZ8MTXP01BO1VM.15.1.A01.1.454.CMB.2.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagtctacgtagccacgaccggtgctcgatttagacgtctcatcaggggccgtgggctctgctgctcctcactctcctcactcaggacacagggtcctgggcccagtctgccctgactcagcctgctccgtgtctgggtctcctggacagtcgatcaccagtctcctgcactggaaccagcagtgagtcggttggggtanctaccttgtctcgtggtaccaacaccgacccgnaggacaccccaaagtcaatgagttttacnggacggacctaaacgacgacggtaccctcgaaggtcttttacaagtccgtcctttctcgtcggtcccttaccgaagttccgaggtaccgaacccgtaaccggtccctttcccgaaggtaactaaacgttccgtccggtcggggtaaccttcggaacggtcgttaacccgggaaacccgttaaggacgggtttacccttaaaagtttacctaaccgttccgggtaacttcgggtacccgttaacgtaaacggggttacttaacgggggtttaaacgtttaaaccgtaaaaccgtaaacccgtttaactttaaccgtaaaccggggtttcccggggtaaaccggtaaacgggggtaaaccctttaaacggggcggtttaaacccgggtacccgtccgggtttacggaaccccgggttcaaccggtaaccccgaaacggttccccggttaaaccggggtaccccccccttggggtaaccctacccgtttcccgttacccctttacccccggacgttccccttaccggttaaaccccgttggtttaacccggacgttaacggggacgtccgggggaacttccgggaacgggtaaccg

SEQ ID NO: 328238 - DNA, 687 bp, Homo sapiens
  misc_feature: GZ8MTXP01CT1FS.15.1.A01.1.454.CMB.2.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctctgcactggaaccagcagtgagttcggttggggttaactctactttcgtccttccgtcggtaaccaaccacccacccggnacggaccacccctaatctatagtattagnggacgaccaacgaacgccgaccctaggacggttactttactaatccgtacttctacgtcggtacctcgaaagttcgagaccaacgaccgtcctcccganactaactctccggcggtctcgaagctaacgaagcgtagtacttaaattacgacnggcctgaccttanagttaagtagtaaacttacaactacgttaataccggtaagtccgggaacggaacgtacgtacgggtaccgttacgtaccgttccggtacgtaccgtaccgaccgtacccgtaccgtcccgtccccgtacccgtcggttaacctccgttcccgttacccgttaccccgttaccgttccgttaccggttaacggttaccgtaagggtcgtaaccggggaccgggtccgggttacgtaacggaacgtaaccg

SEQ ID NO: 328239 - DNA, 579 bp, Homo sapiens
  misc_feature: GZ8MTXP01DLNJU.15.1.A01.1.454.CMB.2.raw
  modified_base (253)..(253): a, c, t, g, unknown or other
  misc_feature (253)..(253): n is a, c, g, or t
  modified_base (395)..(395): a, c, t, g, unknown or other
  misc_feature (395)..(395): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccaccccggcagacgcccccaaatcatgatttangaggccactaagcgaccctcaggtctttctaatcgctttctctggctccaagtctggcaacacggcctcctgacatctctgggctccgaggctgacgcgaggctaaattattactgctgcttcattagtagtaaggtttaanaaactactattaactagttcgggacgggaacgggaacccgaagggtctacggacccgtccgttgccgtcgacgaccccaagggtcctcgccccctcgggtccaccgttcgttcccgttccccgtccccttcccgttacgccttaaccggtgtaccgtggacggcggggttctgggccgaacggg

SEQ ID NO: 328240 - DNA, 659 bp, Homo sapiens
  misc_feature: GZ8MTXP01ADXFB.15.1.A01.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttggggttatcacttgtctctgtaccaacnccacccggnagacgaccccaaatcatgtattatgacggcacagcgtaccctgaggtctttactaagtccgtctttctcgtcggtacctaccctaagtccgtggacaaccgaccggtcctccctagacaagtccttccgtcggggctaccgaggcctaggaccgcgtaggtacttaaattatactcgtcttacgctacaatagtagtaaggttaactaactactaatacgttaggttccgggacgggagggacccaaggggtcctacgtaacccgtcgttacggctacgaccggaacccgtacggtcccgttaaccggcccccgttgggtaacccctaccgttccggtttcccgttaccccctccccgttcccgttccgttacgttaccggtaacgtcccggttgggaacgggtcccgggttaacgtcgggaacgaacgggg

SEQ ID NO: 328241 - DNA, 633 bp, Homo sapiens
  misc_feature: GZ8MTXP01DT28Y.15.1.A01.1.454.CMB.2.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggttatcacttgtctcngtaccacaccacccggnagacgccccaaatcatgattangagaccactaagcgaccctnaaggtctttactaatcgtcttctcgtggctccgaagtctggaccaacgacggccctccctgaactatcctacgtcggctaccgaggcgtaacgaacggaagacggtactaaagtttattaccgtagtctagctctaatatagtaaaggttaactaaactaacttaacttaacgttaacgttacgggaccggtaacggggaacccgtaacggggtacgtacggtaccccgttacgtcgtccgttacgaccggacccgtaacggtcccgtaccgcccccgtcggtaacctccttccgtcccgttccccgtcccgttcccgttccgttccttacggttaagacgtcggtacggcgggctcggccgaacgg

SEQ ID NO: 328242 - DNA, 513 bp, Homo sapiens
  misc_feature: GZ8MTXP02GDFVS.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctcctggggctccaggctgacgcgaggctaaattattactgctgctcatatgaaggttataacactatactattcgcggagggaccaagctgaccgtcctgcgtcagcccaaggctcgccccctcggtcactctcgttcccaccctcctcgctacgtaagactgacgcgggctggcaacgg

SEQ ID NO: 328243 - DNA, 495 bp, Homo sapiens
  misc_feature: GZ8MTXP02J0BLU.15.1.A01.1.454.CMB.2.raw
  modified_base (491)..(495): a, c, t, g, unknown or other
  misc_feature (491)..(495): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttgccatggggccagggaccctggtcatcgtctcgtcagcctccaccaagggcccatcgtctcccctgcaccctcctccagacgcacctctggggcacagcgccctgggctgcctggtcaaggctactccgctacgtagactgagcgggctcggcaaggcgcatagnnnnn

SEQ ID NO: 328244 - DNA, 460 bp, Homo sapiens
  misc_feature: GZ8MTXP02G7NIM.15.1.A01.1.454.CMB.2.raw
  modified_base (447)..(460): a, c, t, g, unknown or other
  misc_feature (447)..(460): n is a, c, g, or t
tcagtctacgtagccacgaccggtgctcgatttagacgtctcatcagggcctgggctctgctgctcctcactctcctggacagtcgatcaccatctcctgcactggaaccagcagtgatgttggggttatcaccttgtctcctggtaccaacaccaccccggcagagcccccaaactcatgatttatgaggccactaagcgaccctcagggctttctaatcgcttctctggctccaagtctggcaacacggccctccctgacaatctctgggctccaggctgacgacgaggctaaattattactgctgctcatatgaagttataacactatacctatcggcggagggaccaagctgaccgtctgcgtcagcccaaggctgccccctgtcactctcgttccccaccctcccgctacgtagactgacgcgggctggcaaggcgcatagnnnnnnnnnnnnnn

SEQ ID NO: 328245 - DNA, 557 bp, Homo sapiens
  misc_feature: GZ8MTXP02IS1U9.15.1.A01.1.454.CMB.2.raw
  modified_base (381)..(381): a, c, t, g, unknown or other
  misc_feature (381)..(381): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaaactcatgatttatgaggccactaaagcgaccctcagggctttcaatcgcttctctggctccaagtctggcaacacggcctccctgacaatctcctgggctccaggctgacgcgtaggctaaattattactgctgctnatagtagaaagttactaacactatactagtcggacggaaggacaagctacgaccgtctgcgtcacgacccgaaggcctccgcccccgtcggtacctaccttccttccgttcccccaccccttccctccgtaccttaacgtaacgtacgtacggacggcgggtcgtacggacgacgg

SEQ ID NO: 328246 - DNA, 507 bp, Homo sapiens
  misc_feature: GZ8MTXP02JZ6HI.15.1.A01.1.454.CMB.2.raw
  modified_base (465)..(465): a, c, t, g, unknown or other
  misc_feature (465)..(465): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctcctgggctccaggctgacgcgaggctaattatactgctgctcatatgaaggttataacactatactattcggcggagggaccaaagctgaccgtcctgcgtcagcccaaggctcgccccctcggtcactcncgttccccgcctcctcgctacgtgactgagcggctggcaagg

SEQ ID NO: 328247 - DNA, 559 bp, Homo sapiens
  misc_feature: GZ8MTXP02GRX8Q.15.1.A01.1.454.CMB.2.raw
  modified_base (294)..(294): a, c, t, g, unknown or other
  misc_feature (294)..(294): n is a, c, g, or t
  modified_base (554)..(554): a, c, t, g, unknown or other
  misc_feature (554)..(554): n is a, c, g, or t
  modified_base (556)..(559): a, c, t, g, unknown or other
  misc_feature (556)..(559): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttcngtgcgagagacgggtataatagttactggtttgccagtggggccagggaccctggtcatcgtctcgtcagcctccacagggcccatcggtccttcccctggccacccctcctccaagacgccaccctcgtcgggggccacgacgccggccccgtggggcctcggcccgtcgggtccaaacgggaccttaaccgtttcccgcgttaaccgtacggaccgttggaacggccggggccgtcgggacgaagggccgcagtacgngnnnn

SEQ ID NO: 328248 - DNA, 505 bp, Homo sapiens
  misc_feature: GZ8MTXP02HAJ62.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctcctgggctccaggctgacgcgaggctaattattactgctgctcatatgaagttataacactatactattcggcggagggaccaagctgaccgtctgcgtcagcccaaggctcgccccctcggtcactctcgttcccacctcctcgctacgtgactgacgcggctggcacgg

SEQ ID NO: 328249 - DNA, 518 bp, Homo sapiens
  misc_feature: GZ8MTXP02FQOO2.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcaggctttctaatcgctttctctggctccaagtctggcaacacggcctccctgacaatctctgggctcaggctgacgcgagctaaattattactgctgctcatatagtaaagttaataaacacttataacttagtacggacggagggaccaaagctgacccgtctgccgtcacgccaaggctcgcccctcggcactctcgtcccacctcctcgcttacgaagactgacgcggcgcgacgacg

SEQ ID NO: 328250 - DNA, 531 bp, Homo sapiens
  misc_feature: GZ8MTXP02IPBB7.15.1.A01.1.454.CMB.2.raw
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcagggctttctaatcgctttcnctggctccaaagtctggcaaacacggcctcccctgaccaaatctcctgggctcaggctgacncgagctaaattattactgctgctnatatagaagttaataacactaatactagtacggacggaaggaccaagcgtacgtacccgtcgtcgcgtcacgaccgaagctcgccccgtcgtcactctcgtcccacctcctcgtactacgtaagactggacggcggctaggacaagg

SEQ ID NO: 328251 - DNA, 510 bp, Homo sapiens
  misc_feature: GZ8MTXP02HQJ7C.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgctttctctggctccaagtctggcaacacggcctccctgacaatctctggggctccaggctgacgacgaggctaaattattactgctgctcatatgaagttataacactatactattcgcgagggaccaagctgaccgtctgcgtcagcccaaggctgccccctcggtcactctcgttcccaccctcctcgcctacgtgacctgacgcgggctcggcaagg

SEQ ID NO: 328252 - DNA, 600 bp, Homo sapiens
  misc_feature: GZ8MTXP02HNZIQ.15.1.A01.1.454.CMB.2.raw
  modified_base (230)..(230): a, c, t, g, unknown or other
  misc_feature (230)..(230): n is a, c, g, or t
  modified_base (391)..(391): a, c, t, g, unknown or other
  misc_feature (391)..(391): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggggttatcacttgtctcctggtaccaacaccacccggnagaccgaccccaaactcatgtatttatggaggaccactaagccgacccctcgaggtcctttactaatccgtctttctcttcggtttaccaagttcgtggaccaaacgaccgggtccctcccgtgaaactaactctcgtcgggcctccgaggctggacgagnggtacttaaattattactgctgctcatatagtaagttaataactactatacttagttcgggacgggaaggacgaaacgtctacggaccgtcgtcgcgtcgacgacccgaaggcctccgcccccgtcgtccaccttccgtccttaccccctaccctccgtaccgaccgttacgtacgaaccgtggacggcgggcgtcggacgaacggccg

SEQ ID NO: 328253 - DNA, 532 bp, Homo sapiens
  misc_feature: GZ8MTXP02HXW5V.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctccctgacatctctgggcctcaggctgacgcgaggctaaattattactgctgctcatatgaaaggttataaacactatactagttcggcggaggaccaaagctgaccgtctcgcgtcagcccaaggcctcgccccctcggtccacgttcctcgttccccacccttccctcgcctacgtaacgacgtcgacggtccggcgtcggacgaacgg

SEQ ID NO: 328254 - DNA, 513 bp, Homo sapiens
  misc_feature: GZ8MTXP02JTLKY.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctccaggctgacgcgaggctaaattatactgctgctcatatgaaggttataacactatactattcggcggaggaccaaaggctgaccgtctgcgtcagcccaaggctcgccccctggtccactctcgttcccgccctcctcgctacgtaagactgacgcggctcggcaacgg

SEQ ID NO: 328255 - DNA, 515 bp, Homo sapiens
  misc_feature: GZ8MTXP02I7UKI.15.1.A01.1.454.CMB.2.raw
  modified_base (407)..(407): a, c, t, g, unknown or other
  misc_feature (407)..(407): n is a, c, g, or t
tcagtctacgtagccacgaccggtgctcgatttagacgtctcatcagggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccggggggtccctgagactctcatgtgcaggctctggattcagcgtcaggatagttacatgagttggtccgcaggctccagggcaggggctagagtggctctcaatgatttacaccgatggggacggtgggaccacatactacgcagattccgtgaagggcagattcaccatctccagagacatttgganaacaccgtgattcttaaatatagaacagacctgagagccgatgacacgctgtgtatttctgtgtcgagagacgggtaataagtagttactggtttggcctagtcgggg

SEQ ID NO: 328256 - DNA, 511 bp, Homo sapiens
  misc_feature: GZ8MTXP02J3OX1.15.1.A01.1.454.CMB.2.raw
  modified_base (481)..(481): a, c, t, g, unknown or other
  misc_feature (481)..(481): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggggttatcaccttgtctcctggtaccaacaccaccccggcagagcccccaaactcatgatttatgaggccactaaagcgaccctcagggctttctaatcgcttctctggctccaagtctggcaacacggcctccctgacaatctcctggggctccaggctgacgcgaggctaaattattactgctgctcatatgaaggtatacactatactaattcgcgagggaccaagctgaccgtcctgcgtcagcccaaggcctcgccccctggtccactctcgttcccaccctcccncgctacgtaagacgcgacgcggcgcggcag

SEQ ID NO: 328257 - DNA, 526 bp, Homo sapiens
  misc_feature: GZ8MTXP02IG9XJ.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgccccaaactcatgatttatgaggccactaaagcgacccctcagggctttctaatcgcttctctggctccaagtctggcaacacggctccctgacaatctcctgggctccaggctgacgcgagctaaattattactgctgctcattatgaagttataaacactaatactagttcggacggagggaccaaagctagaccgtcctgcgtcacgcccaaggcctcgccccctcggtccactctcgttccccgccctccgtcgctaccgtgactcggacgcgggctcggcaacgg

SEQ ID NO: 328258 - DNA, 517 bp, Homo sapiens
  misc_feature: GZ8MTXP02IFI67.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctcaggctgacgcgagctaaattattactgctgctcatatgaaggttataacactatactattcggcggaggaccaaagctgaccgtctgcgtcagcccaaggctcgccccctcggtcacgttctcgttccccaccctcctcgctacgtaagacgtcgacgcggctcggcgaacgg

SEQ ID NO: 328259 - DNA, 525 bp, Homo sapiens
  misc_feature: GZ8MTXP02H2MU3.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcagggctttctaatcgcttctctggctccaagtctggcaacacggcctccctgacaatctcctgggctccaggctgacgcgagctaaattatactgctgctcatatgaagtataaacactatactattcggacggtagggaccaagctgaccgtctgcgtcagcccaaggcctcgccccctcggtccactcctcgttccccacccttccctcgtcctacgtaacgactacgacgcggcgtggaccaagg

SEQ ID NO: 328260 - DNA, 519 bp, Homo sapiens
  misc_feature: GZ8MTXP02HQVYD.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaaagcgaccctcagggctttctaatcgctttctctggctccaagtctggcaacacggcctccctgacaatctcctgggctccaggctgacgcgaggctaaattattactgctgctcatatgaagtttataacactatactattcggcggtagggaccaagctagaccgtctgcgtcagcccaaggctcgccccctggtcacgtctcgttcccaccctcctcgcctacgtaagacctggacgcggctcggcaacgg

SEQ ID NO: 328261 - DNA, 510 bp, Homo sapiens
  misc_feature: GZ8MTXP02G6DYA.15.1.A01.1.454.CMB.2.raw
  modified_base (252)..(252): a, c, t, g, unknown or other
  misc_feature (252)..(252): n is a, c, g, or t
  modified_base (330)..(330): a, c, t, g, unknown or other
  misc_feature (330)..(330): n is a, c, g, or t
  modified_base (476)..(476): a, c, t, g, unknown or other
  misc_feature (476)..(476): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacaccacccggcacgacgcccccaaactcatgattangagccactaagcgaccctcaggctttctaatcgcttctctggctccaagtctggacaacacggcctccctgacaatcnctggctcagctgacgacgagactaaattatactgctgctcatatgtaaagttataacactatactattcggcggaggaccaaaggctgacctcgtgcgtcacgccctaaggcctcgccccctggtccactctcgtcccaccctccncgctacgtaagacgcggacgcggcgcggacgacg

SEQ ID NO: 328262 - DNA, 566 bp, Homo sapiens
  misc_feature: GZ8MTXP02IXD6O.15.1.A01.1.454.CMB.2.raw
  modified_base (376)..(376): a, c, t, g, unknown or other
  misc_feature (376)..(376): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccggggggtccctgagactctcatgtgcaggctctggattcagcgtcaggatagttacatgagttgggtccgccaggctccagggcaggggctagagtggctctcaatgatttacacgagtggggacggtgggaccacatactacgcagattccgngaaggggcagattcaccatctaccagagacaatttggaagaaacaccgtgaatttactttaaatatagaaacaggaccctaggagacgaccgaatggaacacgggtctcggtgttatttcgtgtacgcgaaggaggtaacggggttaataaagttagtttacgtgggtttacggccgtaacggtcggggg

SEQ ID NO: 328263 - DNA, 574 bp, Homo sapiens
  misc_feature: GZ8MTXP02ILZJX.15.1.A01.1.454.CMB.2.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (491)..(491): a, c, t, g, unknown or other
  misc_feature (491)..(491): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttcctgttgctatttaaaaggtgtccagtgtgaggtgcagctggtgggagtcgtgggggaggcgttggtccaggcccggggggtccctgagactctcatgtgcgaggctcgtggattcagcgtcaaggaatagttacagtgaggttcgggtccnccgaggcctccgagggcgaggggctagagtggctctcaatgtattacacgagtcggggacgtggaccanatactacgcagtacttccggagaacgggcagtatcacatctacagagactaagttggaagaacaccgtagtatttacttaaatagtagaacagacctagagacgaccgatacgaacgacggnttcggttagttatttcgtggtggacgaaggtacgtaagggttaataagttagtttacgttaggttcgaccgtacggtacgggg

SEQ ID NO: 328264 - DNA, 503 bp, Homo sapiens
  misc_feature: GZ8MTXP02H23PJ.15.1.A01.1.454.CMB.2.raw
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctcagctgacncgagctaaattattactgctgctcanatgaagttataacactatacattcggacgagggacaagctgaccgtctgcgtcagccaaggctcgcccctcggtcactctcgttcccaccctcctcgctacgtaagcgtgacgcggctggacagg

SEQ ID NO: 328265 - DNA, 533 bp, Homo sapiens
  misc_feature: GZ8MTXP02IJYGW.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctcctggtaccaacaccaccccgacagacgcccccaaactcatgatttatgaggccactaaagcgaccctcaggctttctaatcgcttctctggctccaagtctggcaacacggcctccctgacaatctctgggctcaggctgacgcgagctaaattattactgctgctcatatgaagttataaacacttaatactagttcggcggtagggaccaaagctgaccgtctgccgtacacgcccgaaggcttcgccccctcggtctaccgtctcgttccccaccctccctacgtctacgtaagtactacggacgcggcgtcggacgaacgg

SEQ ID NO: 328266 - DNA, 514 bp, Homo sapiens
  misc_feature: GZ8MTXP02IQWD7.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgaggccactaaagcgaccctcagggctttctaatcgcttctctggctccaagtctggcaacacggcctccctgacaatctcctgggctcaggctgacgcgagctaatattactgctgctcatatgaagttataacactatactatcgcggaggaccaagctgaccgtctcgcgtcacgcccaaaggcctcgccccctcggtcaccttctcgttccccaccctcctcgcctacgtaagactcgacgcggcgtggacacggg

SEQ ID NO: 328267 - DNA, 564 bp, Homo sapiens
  misc_feature: GZ8MTXP02JYIHP.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcacgacgcccccaaactcatgatttatgaggccactaacgccgaccctcgaggtctttctaatcgtctttctctggcctccaagtcgtggcaacgaccggcctccctgacatctccgtgggcctccgaggctggacgacgagacttaaattattactgctgctacatatagaagttaataacactatactagttcggaggaggacaagctacgaccgtcgtgcgtcgacgcccgaacggcctccgtcccccgtcggtcctaccgttccttccgttccccgttccctccgtccgccgttacgtaacgaccgtggacggcggcgtcggacgaacgg

SEQ ID NO: 328268 - DNA, 543 bp, Homo sapiens
  misc_feature: GZ8MTXP02F2KUB.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcaggctttctaatcgctttctctggctccaagtctggcaacacggcctccctgacaatctcctgggctcaggctgacgcgaggctaaattattactgctgctcatatagaaaggttataaacacttaatacttagttacggcggaaggggaccaaaggctagacccgtccgtagccgtcacgcccgaaggcctcgcccccgtcggtccactctcgttccccgcccttcctcgctacgtaacgacgtggacgtcgggctcggacaacgg

SEQ ID NO: 328269 - DNA, 502 bp, Homo sapiens
  misc_feature: GZ8MTXP02FXR50.15.1.A01.1.454.CMB.2.raw
  modified_base (498)..(502): a, c, t, g, unknown or other
  misc_feature (498)..(502): n is a, c, g, or t
tcagtctacgtagccacgaccggtgctcgatttagacgtctcatcagggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccatggggccagggaaccctggtcatcgtctcgtcagcctccaccaagggcccatcggtcttccccctggcaccctcctccaagagcacctctgggggcacagcggccctggggctgcctggtcaaggctacttcgctacgtagactgagcgggctggcaaggcgcatagnnnnn

SEQ ID NO: 328270 - DNA, 518 bp, Homo sapiens
  misc_feature: GZ8MTXP02I25OT.15.1.A01.1.454.CMB.2.raw
  modified_base (429)..(429): a, c, t, g, unknown or other
  misc_feature (429)..(429): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcaggctttctaatcgcttctctggctccaagtctggcaacacggcctcccctgacaatctcctgggctccaggctgacgcgagctaaattattactgctgctcatatgaaggttataacactatactattcggcgagggacaagctgaccgtcngcgtcacgcccaaggcctcgccccctcggtccactctcgttcccgcccttccaccgcctacgtaacgactcgacgcggctcggcaacgg

SEQ ID NO: 328271 - DNA, 511 bp, Homo sapiens
  misc_feature: GZ8MTXP02I189M.15.1.A01.1.454.CMB.2.raw
  modified_base (437)..(437): a, c, t, g, unknown or other
  misc_feature (437)..(437): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaaagccgaccctcagggctttctaatcgcttctctggctccaagtctggcaacacggcctccctgacaatctcctgggctccaggctgacgacgagactaattatactgctgctcatatgaagttaataacactaatactatcggcgaggaccaagctgacccgtctagcgtnacgcccaagcctcgcccctcggtcactctcgtcccacctcctcgctacgaacgactgacgcggactcggacagg

SEQ ID NO: 328272 - DNA, 495 bp, Homo sapiens
  misc_feature: GZ8MTXP02GXEB3.15.1.A01.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (475)..(475): a, c, t, g, unknown or other
  misc_feature (475)..(475): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcactgtctctgtacacacacccgcanagcccaacncatgattatgagcactaagcgaccctcaggcttctatcgcttctctgcncatctgcacacgccgtccctcgacaactctcctcggctccacggcgtcgacgacgagactaattattactgctgctcatatgtaagttaataacactatactagtcggcggaaggaccaanctgacctcgtncgtnacgccaacggnccgcccctcggtcactctcgttccccacctcgtcgctacgtaagcnggacgcgggctcggacacgg

SEQ ID NO: 328273 - DNA, 419 bp, Homo sapiens
  misc_feature: GZ8MTXP02J2VR6.15.1.A01.1.454.CMB.2.raw
  modified_base (415)..(419): a, c, t, g, unknown or other
  misc_feature (415)..(419): n is a, c, g, or t
tcagtctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaacccctggtcatcgtctcgtcagcctccaccaagggcccatcggtcttccccctggcaccctcctccagagcacctctggggcacagccggccctgggctgcctggtcaggctacttccgctacgtagactgagcgggctggcaaggcgcatagnnnnn

SEQ ID NO: 328274 - DNA, 521 bp, Homo sapiens
  misc_feature: GZ8MTXP02GPLG8.15.1.A01.1.454.CMB.2.raw
  modified_base (316)..(316): a, c, t, g, unknown or other
  misc_feature (316)..(316): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (469)..(469): a, c, t, g, unknown or other
  misc_feature (469)..(469): n is a, c, g, or t
tcagtctacgtagccacgaccggtgctcgatttagacgtctcatcagggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccaggccggggggtccctgagactctcatgtgcaggctctggattcagcgtcaggaatagttacatgagttgggtccgccaggctccgagggcaggggctagngtggctctcaatgatttacaccgagtcggggacgtgggaccacatactacgcagattccgngaagggcagatcacatcncagagacattgganaacacgtgattacttaatatagaacagcctagagagccgatgacacggctgtgtatttcngtgacgagagaacggtaataagtagttacgtggtttacgcctacggtcgggg

SEQ ID NO: 328275 - DNA, 511 bp, Homo sapiens
  misc_feature: GZ8MTXP02HOS7A.15.1.A01.1.454.CMB.2.raw
  modified_base (392)..(392): a, c, t, g, unknown or other
  misc_feature (392)..(392): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgacccctcagggctttctaatcgctttctctggctccaagtctggcaacacggcctcctgacatctcctgggctcaggctgacgacgaggctaaattattactgctgctcatatgaaggttanaacacttatactattacggcggagggaccaagctgaccgtctgcgtcagcccaaggctcgcccctcggtcactctcgtcccgccctcctcgctacgtgactcgacgcggctcggcacgg

SEQ ID NO: 328276 - DNA, 552 bp, Homo sapiens
  misc_feature: GZ8MTXP02H76ZS.15.1.A01.1.454.CMB.2.raw
  modified_base (475)..(475): a, c, t, g, unknown or other
  misc_feature (475)..(475): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctcctggtaccaacaccaccccggcacgacgcccccaaactcatgatttatgaggccactaaagccgaccctcagggtctttactaatcgctttctctggctccaagtctggcaacgcggcctccctgacaatctcctgggcctcgaggctggacgcggacggtacttaaatttattactgctgctcatatagaaaggttaataaactactaatactagttacggacggagggaccaaggctacgaccgtctgcgtcacgcccaaggccncgcccccgtcggtcacttctccgtcccacccttcctccgtacctacgtaacgacgtcggacggcggctcggacacgg

SEQ ID NO: 328277 - DNA, 513 bp, Homo sapiens
  misc_feature: GZ8MTXP02JIV3R.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctccaggctgacgcgaggctaaattattactgctgctcatatgaagttataacactatactattcggcggaggaccaagctagaccgtctgcgtcacgcccaaggctcgcccctcggtccactctcgttcccaccctcctcgctacgtcgactcgacgcggctcggcaacgg

SEQ ID NO: 328278 - DNA, 518 bp, Homo sapiens
  misc_feature: GZ8MTXP02I4ZM9.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctcctgggctccaggctgacgacgaggctaaattatactgctgctcatatgaaggttataacactatactattcggcgagggaccaaagctagaccgtctgacgtcagcccaaggcctacgccccctcggtcactctcgttccccacctcctcgctacgtaagactgacgtcgggctcggcaacgg

SEQ ID NO: 328279 - DNA, 514 bp, Homo sapiens
  misc_feature: GZ8MTXP02I77GC.15.1.A01.1.454.CMB.2.raw
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctcaagtctggcaacacggcctccctgacaatctcctgggctcaggctgacgcgaggctaattattactgctgctcatatgaaggttataaacactatactattcggnggagggaccaagctgaccgtctgccgtnagccctaaggcctcgccccctcggtcacttctcgttccccacctcctcgcctacgtgactcgacgcggctggcaaggg

SEQ ID NO: 328280 - DNA, 538 bp, Homo sapiens
  misc_feature: GZ8MTXP02HE5QN.15.1.A01.1.454.CMB.2.raw
  modified_base (505)..(505): a, c, t, g, unknown or other
  misc_feature (505)..(505): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggcccgggggggtccctggagactctcatgtgcaggctctggattcagcgtcaggaatagttacatgagttgggtccgccaggctccaggggcaggggctagagtggctctcaatgatttacaccgagtcggggacggtgggaccacatacacgcagattccgtagaagggcagattcacatctccagagacaatttggaacgaacaccgtgaatttacttaaatatagaaacagcctgaagacgaccgatgacacggctgtgtatttctgtgcgagagacgggtntaaagtaggttactggtttcgcgtacgtcgggg

SEQ ID NO: 328281 - DNA, 533 bp, Homo sapiens
  misc_feature: GZ8MTXP02IXS6L.15.1.A01.1.454.CMB.2.raw
  modified_base (277)..(277): a, c, t, g, unknown or other
  misc_feature (277)..(277): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccgacagacgacccccaaactcatgatttatgaggccactaaagcgaccctnagggctttctaatcgcttctctggctccaagtctggcaaacacggcctccctgacaatctcctgggcctcaggctgacgngagactaaattatactgctnctnatatagtaaagttaataaactactaataactagttacgggcggaagggacaaacgctagaccgtcctgcgtcacgccgaaaggctcgccccctcggtccactctcgtccccnccctccgtcgacctagtaacgngcgacggcgcgcgacgacg

SEQ ID NO: 328282 - DNA, 508 bp, Homo sapiens
  misc_feature: GZ8MTXP02FPTG2.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcaggctttctaatcgctttctctggctccaagtctggcaacacggcctccctgacaatctctgggctcaggctgacgcgaggctaaattattactgctgctcatatgaagttataacactatactattcggcgagggaccaagctgaccgtctgcgtcagcccaaggctcgccccctcggtcactctcgttcccaccctcctcgctacgtaagactgacgcggctcggcaacgg

SEQ ID NO: 328283 - DNA, 506 bp, Homo sapiens
  misc_feature: GZ8MTXP02HFDUH.15.1.A01.1.454.CMB.2.raw
  modified_base (337)..(337): a, c, t, g, unknown or other
  misc_feature (337)..(337): n is a, c, g, or t
  modified_base (486)..(486): a, c, t, g, unknown or other
  misc_feature (486)..(486): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcagggtctttctaatcgctttctctggctccaagtctggcaacacggcctccctgacatcnctggctcaggctgacgcgagctaattattactgctgctcatatgaagttaataacactatactatcggcgagggacaagctgaccgtctgcgtcacgcccaaggcctcgccccctcggtcaccttctcgtcccgccctcctcgctacgngacgtgacgcggctggcagg

SEQ ID NO: 328284 - DNA, 541 bp, Homo sapiens
  misc_feature: GZ8MTXP02JLYYU.15.1.A01.1.454.CMB.2.raw
  modified_base (537)..(541): a, c, t, g, unknown or other
  misc_feature (537)..(541): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggcctacgtggggccaggggaacccctgggtcatcgtctcgtcagccctccaccgaacgggccccactccggtcccttcccccgtcggccctaccccctccctcccaaacgacgccaccctcgtcgggggccacgacgccggcccgtgggcctcgccgtggtcaaggactacgtccgctacgtagactgagcgggctcggcaggcgcatgnnnnn

SEQ ID NO: 328285 - DNA, 550 bp, Homo sapiens
  misc_feature: GZ8MTXP02HYD7I.15.1.A01.1.454.CMB.2.raw
  modified_base (511)..(511): a, c, t, g, unknown or other
  misc_feature (511)..(511): n is a, c, g, or t
  modified_base (539)..(539): a, c, t, g, unknown or other
  misc_feature (539)..(539): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcacgacgcccccaaactcatgtatttatgaggccactaagcgaccctcaggctttctaatcgcttctctggctccaagtctggcaacacggcctccctgacaatctccgtgggactccaggctgacgacgagtctaaattatactgctgctcatatagaaaggttaataactaactaattaactagttcggacgggaacggggaaccaagctacgacccgtccgtgcgcacggcccaaaggcctccgcccccgtcggtccactcctcgtccccgccctccncgtctacgtaagacctaggacgcggtcncggacaacggg

SEQ ID NO: 328286 - DNA, 522 bp, Homo sapiens
  misc_feature: GZ8MTXP02H5AQD.15.1.A01.1.454.CMB.2.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
tcagtctacgtagccacgaccggtgctcgatttagacgtctcatcagggccgtggggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcactgtctctgacaacaccacccggnagagcccaaatcatgatttagngagacacagcacnagcttnatcntctcngcncagtcagacacncgctcanacatcncgngcacgagcagacgcgagtacttaattatactgctgctacatagtagtaagttaataaactaactataactacgtacggacggaaggaacgaacgacgtacgtacgtacgtacgcgtacgacgaccgacgaccgtcgtcccgtccgtacgtactacctccgtaccctaccctccgtccgtacgtacgtaacgtacgtacgacgcggcgtcgacgacg

SEQ ID NO: 328287 - DNA, 520 bp, Homo sapiens
  misc_feature: GZ8MTXP02GPLX4.15.1.A01.1.454.CMB.2.raw
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttcnctggctccaagtctggcaacacggcctccctgacaatctcctgggctccaggctgacgcgaggctaaattattactgctgctcatatgaaggttataacactatactattcggcggagggaccaaagctgaccgtcctgcgtnacgcccaaggctcgccccctcggtcactctcgttccccacctcctcgctacgtaagacctggacgcgggctcggcaacgg

SEQ ID NO: 328288 - DNA, 515 bp, Homo sapiens
  misc_feature: GZ8MTXP02IKCKG.15.1.A01.1.454.CMB.2.raw
  modified_base (431)..(431): a, c, t, g, unknown or other
  misc_feature (431)..(431): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgccccaaactcatgatttatgaggccactaaagcgaccctcaggctttctaatcgctttctctggctccaagtctggcaacacggcctccctgacaaatctcctgggctccaggctgacgcgaggctaaattattactgctgctcatatgaaagttataaacatatactattcggcgagggaccaagctgaccgtcngctcacgcccaaggctcgccccctcggtcactctcgtccccgccctcctccgctacgtaagactggacgcgggctcggcaacgg

SEQ ID NO: 328289 - DNA, 507 bp, Homo sapiens
  misc_feature: GZ8MTXP02HT51B.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctcctgggctcaggctgacgcgaggctaaattattactgctgctcatatgaaggttataacactatactattcggcgagggacaagctgaccgtctgcgtcagcccaaggctcgccccctcggtcattctcgttcccaccctcctcgctacgtaagactgacgcggctggcaacgg

SEQ ID NO: 328290 - DNA, 523 bp, Homo sapiens
  misc_feature: GZ8MTXP02GXPI7.15.1.A01.1.454.CMB.2.raw
  modified_base (382)..(382): a, c, t, g, unknown or other
  misc_feature (382)..(382): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgaggccactaagcgaccctcaggctttctaatcgcttctctggctcaagtctggcacacggcctcctgacaatctctgggctcagctgacgcgagctaaattattactgctgctcatatagaagttanaacactatactattcgtcggagaccaagctgaccgtctgccgtgacgacccgaaggcctcgcccccgtcggtacacgttcctccgttccccgccctccgtccgcttacgtaacgactcggacgccgggctcggacgaacgg

SEQ ID NO: 328291 - DNA, 554 bp, Homo sapiens
  misc_feature: GZ8MTXP02HZQOB.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccaggccggggggtccctgagactctcatgtgcaggctcgtggattcagcgtcaggaatagttacatgagttgggtccgcaggctccgagggcaggggctagagtggctctcaatgatttacaccgtagtcggggacggtgggaccacgatacctacgcagattccgagaaggggcagacttcaccatctaccagagaactaagtttggaagaaaccaccgtgaatttacttaaatatagaacagcctagagagccgatcgacacggctggtgttatttctggtcgacgagagagggtaattaagttaggttactaggtttcggacctaacggtcgggg

SEQ ID NO: 328292 - DNA, 529 bp, Homo sapiens
  misc_feature: GZ8MTXP02GHLHW.15.1.A01.1.454.CMB.2.raw
  modified_base (399)..(399): a, c, t, g, unknown or other
  misc_feature (399)..(399): n is a, c, g, or t
  modified_base (519)..(519): a, c, t, g, unknown or other
  misc_feature (519)..(519): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcagggtctttctaatcgctttctctggctccaagtctggcaacacggcctccctgacaatctcctgggctccaggctgacgcgaggacttaaattattactgctgctcatatagaaaggttanaacactatactagttcggcggagggaccaagcctgacccgtctgcgtcgacgcccgaaggcctcgcccccgtcggtcactctcgtccccacctcctcgctacgtaagacctgacgcggcncggacaacgg

SEQ ID NO: 328293 - DNA, 680 bp, Homo sapiens
  misc_feature: GZ8MTXP02IAB4M.15.1.A01.1.454.CMB.2.raw
tcagtctacgtagccacgaccggtgctcgatttagacgtctcatcagggggagaggagcccagcactgggattccgaggtgtttccattcagtgatctgcactgaacacagaggactcgccatggagtttgggctgagcggtggtttcgtgtaggcgtatttaaaagtgtcagtgtgaggtgcagctggtggagtgtggggaggcgttggtccgaggccgggggtcccgtgagactctcagtgtgcgaggcgtcgtgtattcgagcgtacgaaggtaagtaagttaacgtagtaggtaggttcggtccgaccgacgaccgtaccggacgggacggacgggacgtaggaggtcggtcgtacgtacgtaagtagtacgttacgtacgacggtacggggtacgggtacggacgacgtacgtacgtacgcgaagtacgttacgtacgaacggacgacgtactacctacctacgtaccgtaccgaacgaacgtaacgtaaagttaacggtaaacgaaaccgtacgtaacgttaacttaactttaaagttaagtaagaacgacgtacgtagagacgacgtacgtacgacgacgtacgtcgtgttagttcgtcgtacgtacgtacggtaaggtaacggtaagttaagttaacgttacggttacggttacggtacggtacggtacggg

SEQ ID NO: 328294 - DNA, 563 bp, Homo sapiens
  misc_feature: GZ8MTXP02HU8I1.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaaagccgacccctcagggctttctaatcgcttctctggctccaagtctggcaacaccggcctccctgacaatctctgggctcgaggctgacgacgaggactaaattattactgctgctcatatagaaggttataaacacttaatactagttcggacggaacgggaccaagctcgaccgtcgtgcgtacacgcccgaaggcctccgtccccctcggtccaccttccgtccgttccccgcccccttccgtccgtccgttacgtaacgaccgttcggacggcgggtcctacggacgaacggg

SEQ ID NO: 328295 - DNA, 521 bp, Homo sapiens
  misc_feature: GZ8MTXP02HSALD.15.1.A01.1.454.CMB.2.raw
  modified_base (226)..(226): a, c, t, g, unknown or other
  misc_feature (226)..(226): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctctgtaccaacacacccggnagacgccccaaatcatgatttatgaggccactaaagcgaccctcaggctttctaatcgcttctctggctccaagtctggcaacacggcctccctgacaatctccgtgggctccaggctcgacgcgagactaattatactgctgctcatatcgaagttataacacttatactagttcggcggtagggaccaaagcgttaggaccttcgtgaccgtcacgccaaggccttcgccccctggtcactctcgtccccaccgtcctcgctacgtaagactgacggcggcctggaccaaggg

SEQ ID NO: 328296 - DNA, 507 bp, Homo sapiens
  misc_feature: GZ8MTXP02I6OJV.15.1.A01.1.454.CMB.2.raw
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgattaatgaggccactaagcgaccctcagggctttctaatcgctttctctggctccaagtctggcaacacggcctccctgacatctcctgggctcaggctgacncgngactattattactgctgctcatatgaaggttataacactatactattcgcggagggaccagctgacctctgcgtcagccaaggctgcccctcgtcactctcgtccccacctccctcgcctacgtaagacgtcgacgcggctcggacaacgg

SEQ ID NO: 328297 - DNA, 522 bp, Homo sapiens
  misc_feature: GZ8MTXP02GLBJX.15.1.A01.1.454.CMB.2.raw
  modified_base (385)..(385): a, c, t, g, unknown or other
  misc_feature (385)..(385): n is a, c, g, or t
  modified_base (518)..(522): a, c, t, g, unknown or other
  misc_feature (518)..(522): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacggtataatagttactggtttgcctacgtggggaccagggaacccctggtcatcgtctcgtcagccctccacaaggcccancgtcctcccctgccaccctcctccaagcgcacctcgtcgggggccacgacggcggcccgtggggctcgccgtggtcaaaggtacctaaccgttccgctacgtagacctgacgcgggctggcaaggcgcatagnnnnn

SEQ ID NO: 328298 - DNA, 532 bp, Homo sapiens
  misc_feature: GZ8MTXP02I7CXQ.15.1.A01.1.454.CMB.2.raw
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctcagtgtctgggtctcctggacagtcgatcaccatctcctgcactggaaccagcagtgatgttgggggttatcaccttgtctcctggtaccaacaccaccccggcacgacgcccccaaactcatgatttatgagccataagcgaccctcaggctttcaatcgcttctctggctccaagtctggcaacacggcctcctgacaatcctctgggctccaggctgacgacgaggctaattatactgctgctcatatgaagttanacactatactatcggacggaggacaagtcncgaccgtcctagcgtcacgcccaaggcctcggccccctcgggtccnccgtcgttccgttccccgtccctacccgtcgtacctaacggttagaccgtcgacggcgggtccgcggacg

SEQ ID NO: 328299 - DNA, 618 bp, Homo sapiens
  misc_feature: GZ8MTXP02HAFT9.15.1.A01.1.454.CMB.2.raw
  modified_base (475)..(475): a, c, t, g, unknown or other
  misc_feature (475)..(475): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacaccacccggcagacgcccccaaatcatgtattatgaggccactaagcgaccctcaggtcttctaatcgtctttctctcggctccaagtctaggaccaaccgaccggcccctccctacgaacctaacttcctcccgtggggccctcgacggtctacggacggacgaggtacttaaatttattactgactgctctatatagtaagttaataactactaatactagtacggacggacggacaagcgtacgacccgttcncggctcgacgccgaacggtcctccgcccccgtacggtcctacgttccttccggtaccccctcccttcccgtaccggtaccttaaccgggtaaacgtaccggttacgggacgggtcccggggtcgtacggggacgaaaccgggg

SEQ ID NO: 328300 - DNA, 519 bp, Homo sapiens
  misc_feature: GZ8MTXP02JWPAY.15.1.A01.1.454.CMB.2.raw
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (463)..(463): a, c, t, g, unknown or other
  misc_feature (463)..(463): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgctttctctggctccaagtctggcaacacggcctccctgacaatctctgggctccaggctgacgcgaggctaattatactgctgctcatatgaagttanacactatactatcggnggagggacagctgaccgtcctgcgtcacgcccaaggcctcgccccctcggtccactccncgttcccccacccgtcctccgccttacgaagaccgtgacggcgggctcggcaacgg

SEQ ID NO: 328301 - DNA, 568 bp, Homo sapiens
  misc_feature: GZ8MTXP02ICB60.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggtctttactaatcgcttctctggcctccaagtctggacaacgccggccctccctgacaatctccgtcggctccgaggctgacgacggaggtactaaatttacttactgtctgcttcatatagaaagttaataaacacttatactaagttcgggcggaagggaccagctcgaccgtctcgcgtacacgcccgaacggcctccgcccctcggttcaccgttcttccgttcccccacccttcccgtccgtacttaccgtaacgacctggacggcgggccgtgggaccgacgg

SEQ ID NO: 328302 - DNA, 580 bp, Homo sapiens
  misc_feature: GZ8MTXP02FUM76.15.1.A01.1.454.CMB.2.raw
  modified_base (294)..(294): a, c, t, g, unknown or other
  misc_feature (294)..(294): n is a, c, g, or t
  modified_base (575)..(575): a, c, t, g, unknown or other
  misc_feature (575)..(575): n is a, c, g, or t
  modified_base (577)..(580): a, c, t, g, unknown or other
  misc_feature (577)..(580): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttcngtgcgagagacggtataatagttactggttgccacgtggggccagggaaccctggtcagtcgtctcgtcagccctccaccgaacgggccccatccgtccttcccccgtcggccacccctccctcccaacgacgccacccgtcgtcgggggccacgacgccgggccccgtcggggcctcggcccgttcggtaccgaaacggtaccttaaccgttcccgtacccttacggtacggaccttcggaacggcgggcgtcgggccgaaacgggccgcgaacgtacgngnnnn

SEQ ID NO: 328303 - DNA, 529 bp, Homo sapiens
  misc_feature: GZ8MTXP02HUF6L.15.1.A01.1.454.CMB.2.raw
  modified_base (430)..(430): a, c, t, g, unknown or other
  misc_feature (430)..(430): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctccaggctgacgcgaggctaaattattactgctgctcatatagaaggttataacatatactattcggcggaggaccaagctgaccgtcngcgtcacgcccgaacggcctcgcccccgtcggtccaccttctcgttccccacccctcctccgacctacgtaacgctcgacggcggctacggacgaacgg

SEQ ID NO: 328304 - DNA, 528 bp, Homo sapiens
  misc_feature: GZ8MTXP02IQWNW.15.1.A01.1.454.CMB.2.raw
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgctttctctggctccaagtctggcaacacggcctccctgacatctcctgggctccaggctgacgacgaggctaattattactgctgctnatatgaagttanaacactatactatcggcggaggaccaagctcgaccgtcngccgtcgacgcccgaaggcctcgccccctcggtcacttctccgttccccacccttccgtcgaccttacgtaacgtactcggacgcggctggacaacggg

SEQ ID NO: 328305 - DNA, 532 bp, Homo sapiens
  misc_feature: GZ8MTXP02FG8D2.15.1.A01.1.454.CMB.2.raw
  modified_base (523)..(523): a, c, t, g, unknown or other
  misc_feature (523)..(523): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcaggctttctaatcgctttctctggctccaagtctggcaacaccggcctccctgacaatctcctgggctcaggctgacgacgagctaaattattactgctgctcatatagaaagttaataacatatactagttcggacggagggaccaagctacgaccgtcctgccgtacacgacccaaggcctccgcccccgtcggtccacctctcgttccccaccctcctccgctacgaacgacgtgacggcggcncggcaacgg

SEQ ID NO: 328306 - DNA, 535 bp, Homo sapiens
  misc_feature: GZ8MTXP02JRVHW.15.1.A01.1.454.CMB.2.raw
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggagcttggtccaggccgggggggtccctgagactctcatgtgcaggctctggattcagcgtcaggaatagttacatgagttggtccgcaggctcagggcaggggctagagtggctctcaatgatttacaccgagtcggggacggtggggaccacatacctacgcagattccgtgaagggcagattcaccatctaccagagacaatttgggaanaaccaccgtagatttacttaaatatagaacagcctgagagccgtangacacggctggtattatctgtcgcgagaggtacggtaataagtagttacgtggtttcggcctacgtcgggg

SEQ ID NO: 328307 - DNA, 700 bp, Homo sapiens
  misc_feature: GZ8MTXP02HZA1I.15.1.A01.1.454.CMB.2.raw
  modified_base (416)..(416): a, c, t, g, unknown or other
  misc_feature (416)..(416): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggtttggggttatcaccttgtctcctggtaccaacaccacccggcagacgcccccaaactcatgtatttatgaggccactaagccgaccctcgaggtcctttactaatccgtctttctcgtcggcctaccaagtctggaccaacgaccggtcctccctagaccaatctccgtcgggcctcgaggctggaacgacgaggtacttaaatttacgttactgacttcgctanattataggtaaagttaataaactacttataacgtagttcgggacgggaaacggtaccgaaacggtcgttacggaacccgttccgttcggaccgttaccgaacggtccccgaaagggtcccgttaccccggtcccccccgttccgggttaacctacccgtttacccgtttcccggtttacccccctaccccgtttcccccgttaccggttaacccgttaaccggttaacggtacgttacggggacggggtaccggggtccggtttacggggaaccggtaacgggg

SEQ ID NO: 328308 - DNA, 516 bp, Homo sapiens
  misc_feature: GZ8MTXP02FVTXV.15.1.A01.1.454.CMB.2.raw
  modified_base (291)..(291): a, c, t, g, unknown or other
  misc_feature (291)..(291): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttgggtccaggccgggggggtccctgagactctcatgtgcaggctctggattcagcgtcaggatagtacatgagttggtccnccaggctccgagggcaggggctagagtggctctcaatgatttacaccgagtcggggacgtgggaccacatactacgcagattccgagaagggcagattcacatctcagagacaatttggagaacacgtgattctaatatagaacagctgagagccgatgacacggctgtgtattcgtgtgcgagagacgggtaataagtagttactggtttcggctacgtcgggg

SEQ ID NO: 328309 - DNA, 528 bp, Homo sapiens
  misc_feature: GZ8MTXP02HXHS8.15.1.A01.1.454.CMB.2.raw
  modified_base (365)..(365): a, c, t, g, unknown or other
  misc_feature (365)..(365): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcaggctttctaatcgcttctctggctccaagtctggcaacacggcctccctgacatctctggctcaggctgacgcgagctaattattacngctgctcatatgaaaggttataaacacttatactagttcgggcggaagggaccaagctagacccgtccgtgcgtcacgcccgaaggcctcgcccccgtcggtccacttctccgttccccaccctcctcgcctacgtaacgacgtgacggcggctggacaacgg

SEQ ID NO: 328310 - DNA, 509 bp, Homo sapiens
  misc_feature: GZ8MTXP02HJOOS.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctcctgggctcaggctgacgcgaggctaaattatactgctgctcatatgaagttataacactatactattcggcggagggaccaagcgtgaccgtctgcgtcagcccaaggctcgcccctcggtcactctcgttcccgcctcctcgctacgtaagacgtgacgcggctggcaacgg

SEQ ID NO: 328311 - DNA, 533 bp, Homo sapiens
  misc_feature: GZ8MTXP02GSSCT.15.1.A01.1.454.CMB.2.raw
  modified_base (294)..(294): a, c, t, g, unknown or other
  misc_feature (294)..(294): n is a, c, g, or t
  modified_base (529)..(533): a, c, t, g, unknown or other
  misc_feature (529)..(533): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttcngtgcgagagacggtataatagttactggttgccagtcggggccagggaaccctggtcatcgtctcgtcagccctaccaccgaacgggccccatccgtcccttccccctcggccacccctccctccaacgacgcacctcgtcggggcacgacgccgccctgggctcgccgtggtacaacggctaccgttccgctaacgtacgactcggacgcggcgtcggcgaacggcgcactagnnnnn

SEQ ID NO: 328312 - DNA, 529 bp, Homo sapiens
  misc_feature: GZ8MTXP02G1ENN.15.1.A01.1.454.CMB.2.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgagccactaagcgaccctcaggctttctaatcgcttcnctggctccaagtctggcaacacggcctcccngacaatctctcgggctccgagctagacgacgaggtctaaattattactgctgctcatatagtaagttataaacactatactagtcggacggaagggacaagctcgaccgtcctagccgtcacgcccgaagcctcgccccctcggtccactctccgttcccaccctccgtcnctacgtaacgctcggacgcggcncggacaacgg

SEQ ID NO: 328313 - DNA, 522 bp, Homo sapiens
  misc_feature: GZ8MTXP02IFHPO.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttctctggctccaagtctggcaacacggcctccctgacaatctctggctccaggctgacgcgaggactaaatttattactgctgctcatatagtaaaggttataaacactatactattcggcggagggaccaagctgaccgtcctgcgtcagcccaaggctcgccccctcgtcactctcgttcccgccctcctacgctacgtgacctagacggcggcgtcggacgacgg

SEQ ID NO: 328314 - DNA, 539 bp, Homo sapiens
  misc_feature: GZ8MTXP02IREF5.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggtctttctaatcgctttctctggcctccaagtctggcaacacggcctccctgacaatctcgtgggctccaggctgacgacgagtactaaattattactgctgctcatatagaagtttataaacacttaatacttagtcggacggagggaaccaagcgtgacccgtctacgcgtacacgcccgaaggcctccgccccgtcgtcactctcgttccccgcccttcctccgctaccgtaagacgtcggacgcggctcggacacgg

SEQ ID NO: 328315 - DNA, 545 bp, Homo sapiens
  misc_feature: GZ8MTXP02JSH6U.15.1.A01.1.454.CMB.2.raw
  modified_base (326)..(326): a, c, t, g, unknown or other
  misc_feature (326)..(326): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcagacgcccccaaactcatgatttatgaggccactaaagccgacccctcgagggtctttctaatccgctttctctggcctccaagtctggccaacnccggccctccctgacatctctggtctccaggctgacgcgagacttaattatactgctgctacatatgaaagttataacatatactagtcggacggacgggacagctgaccgtctgcgtcacgcccgaaggcctcgccccctcggtccaccttcgtccgttccccgcccttccgtccgcgtaaccgtaacgcggtacggccgggcgtcggacgacggccg

SEQ ID NO: 328316 - DNA, 568 bp, Homo sapiens
  misc_feature: GZ8MTXP02IGR0U.15.1.A01.1.454.CMB.2.raw
  modified_base (505)..(505): a, c, t, g, unknown or other
  misc_feature (505)..(505): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatcaccttgtcttcctggtaccaacacccaccccggcacgacgacccccaaactcatgtatttatgagccactaagcaccctcaggtctttctaatcgtctttctcgtggcctaccaagtctaggccaacgaccggtccctcccgtagacaatctaccgtcggctccgaggctgacgcgagtactaaagttatactgctgctacatatagtaagttaataaactacttaagtactagttacggcggaacggaaccaagctagacccgtcgtacgccgtcacgccgaagcctccgccccctcggtcncgttctccgttcccgcctccgtcgactaccgtaacgacgtcggacgcggcgtacggacgacgg

SEQ ID NO: 328317 - DNA, 545 bp, Homo sapiens
  misc_feature: GZ8MTXP02H2X1W.15.1.A01.1.454.CMB.2.raw
  modified_base (492)..(492): a, c, t, g, unknown or other
  misc_feature (492)..(492): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggtttccttgttgctatttaaaaggtgtccagtgtgaggtgcagctggtggagtcgtgggggaggcttggtccaggccgggggggtcctgagactctcatgtgcaggctctggattcagcgtcaggaatagttacatgagttgggtccgccaggctccgaggggcaggggctagagtggctctcaatgattaccacgagtggggacgtgggacacatactacgcagtacttccggagaaggggcagtacttcacatctaccagagactaagtttggaagaacaccgtagtaacttacttaaatattgaaacagcctagagacgcgatgacacggctgtcgttatttcgngttacgcgagagaacgggtaatagtaagttacgtggtttcggctacgtcgggg

SEQ ID NO: 328318 - DNA, 563 bp, Homo sapiens
  misc_feature: GZ8MTXP02IX3PW.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggtctttctaatcgtcttctctggctccaagtctggcaacacggcctccctgacaatctcctggctcaggctgacgcgagtactaaattattactgctgctacatataggtaaagttataaactacttaatacgttagttcgggacggtaagggaaccagctacgtacccgttcgtcgccgtcgacgccgaacggtcctccgcccccgtcggtactccttccgtccgttccccgcccttccgtcgtaccgtacgtaagaccgtggacgcgggcctcggacgaacgg

SEQ ID NO: 328319 - DNA, 506 bp, Homo sapiens
  misc_feature: GZ8MTXP02ILEBZ.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctcagtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttcaatcgcttctctggctccaagtctggcaacacggcctcctgacaatcctctgggctccaggctgacgacgagctaaattattactgctgctcatatgaaagttataacatatactattcggacggaggaccaagctgaccgtctgcgtcacgccaaggctcgccccctcggtcacctctcttcccgccctcctcgctaacgtagactcgagcggctcggacg

SEQ ID NO: 328320 - DNA, 534 bp, Homo sapiens
  misc_feature: GZ8MTXP02GPF3K.15.1.A01.1.454.CMB.2.raw
  modified_base (524)..(524): a, c, t, g, unknown or other
  misc_feature (524)..(524): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggtatcacttgtctcctggtaccaacaccacccggcagacgccccaaactcatgatttatgaggccactaagcgaccctcagggtctttctaatcgcttctctggctcaagtctggcaacaccggcctccctgacaatctctgggctcaggctgacgcgagactaaattatactgctgctcatatagaagttaataaacacttaactacttagttacgggacgggaaaggacccgaaaggcttagacccgtcgtgccgtacacgacccaaggcctcgcccccgtcggtaccactctccgttcccacctcctcgctacgaagactagacgcgcncggacaacgg

SEQ ID NO: 328321 - DNA, 553 bp, Homo sapiens
  misc_feature: GZ8MTXP02FW4XY.15.1.A01.1.454.CMB.2.raw
  modified_base (549)..(553): a, c, t, g, unknown or other
  misc_feature (549)..(553): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgattttacaccgatggggacggtgggaccacatactacgcagattccgtgaagggcagattcaccatctccagagacaatttggagaacaccgtgattctaatatgaacagcctgagagccgatgacacggctgtgtatttctgtgcgagagacggtataatagttactgttgcacgtgggccaggacctgtcattcgtctcgtcacgccctccaaccgaacgggccccactccggttcccttccccccgtcggcccaccccgtccctcccgaacgacgccacccgtccgtcgggggaccacgacggccggccccgtcgggctcgccgtcggtcgaacggactaccgtccgctacgtacgacgtcggacggcgggtcgtcggacgaggcgcgagtagnnnnn

SEQ ID NO: 328322 - DNA, 543 bp, Homo sapiens
  misc_feature: GZ8MTXP02F1PEW.15.1.A01.1.454.CMB.2.raw
  modified_base (330)..(330): a, c, t, g, unknown or other
  misc_feature (330)..(330): n is a, c, g, or t
  modified_base (395)..(395): a, c, t, g, unknown or other
  misc_feature (395)..(395): n is a, c, g, or t
  modified_base (481)..(481): a, c, t, g, unknown or other
  misc_feature (481)..(481): n is a, c, g, or t
  modified_base (532)..(532): a, c, t, g, unknown or other
  misc_feature (532)..(532): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagccgaccctcagggctttctaatcgctttctctggctccaagtctggcaacacggcctcccngacatctcctgggcctcaggctgacgcgaggctaattattactgctgctcatatagaaggttaanaacactaatactagttcggcggaagggaccaaagcgtcgacccgttcctgccgtcgacgcccgaaggcctccgccccctcggtccnccgttcctccgttcccccaccttccctcgctacgtcgacgtgacgcggtcncggacgaacgg

SEQ ID NO: 328323 - DNA, 538 bp, Homo sapiens
  misc_feature: GZ8MTXP02IBAT8.15.1.A01.1.454.CMB.2.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctggggtctcctggacagtcgatcaccatctcctgcactggaaccagcagtgatggttgggggttatcaccttgtctcctggtaccaacaccaccccggnagacgccccaaactcatgatttangaggccactaagcgaccctnaggctttctaatcgntctctggctccaagtcnggcaacgcgctcctgacatctcctgggctccgaggctgacgacgagctaaattactactgcttgctcatactagaaggtataacactataactatcggacggaggaccaagctagaccgtcgagcgtcacggcccaagggcctcgcccccgtcggtccacgttcacgtttcccccaacccttccctacgtctaactaacgacgtaggacggcggggactggacaacggg

SEQ ID NO: 328324 - DNA, 534 bp, Homo sapiens
  misc_feature: GZ8MTXP02G84J1.15.1.A01.1.454.CMB.2.raw
  modified_base (496)..(496): a, c, t, g, unknown or other
  misc_feature (496)..(496): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcacgacgcccccaaactcatgatttatgaggccactaagcgaccctcagggctttctaatcgctttctctggctccaagtctggcaacacggcctcctgacaatctccgtggctccgaggtctgacgacgaggtctaaatttattacctgcctgctcatatagaagttataaacactatactagttcggacggaagggaccaagctagacccgtcgtgcgtcacgccaaggcctcgcccctcggtccactcctctcccaccctccnccgtctacgtaagactcggacgcgggctcggacaacgg

SEQ ID NO: 328325 - DNA, 531 bp, Homo sapiens
  misc_feature: GZ8MTXP02FUM6F.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttatgaggccactaagcgaccctcaggtctttctaatcgcttctctggctccaagtctggcaacacggcctccctgacaatctctggctcaggctgacgcgagctaattatactgctgctcatagtagtaaaggttataaacacttaatactagttcggacggagggaaccaagctgaccgtctgccgtcacgcccgaagcctcgcccccgtcgtccacgtctccgttccccgccctccgtcgctacgtaacgactcggacggcggtctcgggaccaaggg

SEQ ID NO: 328326 - DNA, 618 bp, Homo sapiens
  misc_feature: GZ8MTXP02ISPG3.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccgaggccgggggggtccctgagactctcatgtgcaggctcgtggattcagcgtcaggaatagttacatgagttgggtccgcgaggctccgaggggcaggggctaggagtggctctacaatgaatttacgacgagtcggggacggtgggaccagatactacgcagacttccgtgaacggggcaagattacaccatcctaccagacgaactaagtttggaacgaaacgacgtagtattacttaaatagtagaacacgaccgtgaagtacgaccgaagtacgacgaacggcgttggtacgtttagtttccgtggtacggaccggtaacgggtaggtaacggggttaattaaacgttaggttttacggtacggggttttacggacccgtacggggttaccggggg

SEQ ID NO: 328327 - DNA, 524 bp, Homo sapiens
  misc_feature: GZ8MTXP02JTWRS.15.1.A01.1.454.CMB.2.raw
  modified_base (393)..(393): a, c, t, g, unknown or other
  misc_feature (393)..(393): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggtatcaccttgtctcctggtaccaacaccaccccggcagacgcccccaaactcatgatttatgaggccactaaagcgacccctcagggctttctaatcgctttctctggctccaagtctggcaacacggcctccctgacaatctcctgggctcaggctgacgcgagctaattattactgctgctcatatagtaaggttaanaacactatactagttcgcggagggacagctgaccgtctgcgtcacgcccaaggcctcgccccctacggtccactctccgtccccaccctcctccgtcgtacgtgacctggacggcggcgtcgggcaacggg

SEQ ID NO: 328328 - DNA, 675 bp, Homo sapiens
  misc_feature: GZ8MTXP02G3WVU.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttgggtccagggcccgggggggtccctggagactctcatgtgcaggctctggattcagcgtcaggaatagttacatgagttgggtccgcaggctccgaggggcgaggggctaggagtggctctcaatgaatttacaccgtagtcgggggacggtgggaccacatactacgcagtacttccggtagaacggggcaaggtacttaccaacctatcctacccgaagaagaactaaagtttgggaacgtaaaccgaccggttagtaaactttacctttaaaatacgttaagaaatacggacccgttaggaaggacggaccgagtacggaaccgtacgggtcttggttacgttagttttccgtaggttggaccgtaacgggtaagggtaaaccgggggttaaattaaaacggttacggttttaaccggttgggggttttaccggacccgtaacgggtttacccgggggg

SEQ ID NO: 328329 - DNA, 544 bp, Homo sapiens
  misc_feature: GZ8MTXP02HN6OL.15.1.A01.1.454.CMB.2.raw
  modified_base (481)..(481): a, c, t, g, unknown or other
  misc_feature (481)..(481): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgaggccactaagcgaccctcagggtctttctaatcgtcttctctggctccaagtctggcaacacggcctcctgacatctcctgggctccgaggctggacgacgaggactaaattattactgcttgctacattatagtaaaggtttaataacacttaatactagttcggacggaggacaagctcgaccgtcctgcgtcacgacccgaggcctccgccccctcggtacnctcttcgtttcccgccctccgtcgcctacgtaacgacgtcggacggcggcgtcggacgaacgg

SEQ ID NO: 328330 - DNA, 679 bp, Homo sapiens
  misc_feature: GZ8MTXP02I2VCA.15.1.A01.1.454.CMB.2.raw
  modified_base (317)..(317): a, c, t, g, unknown or other
  misc_feature (317)..(317): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgccccaaactcatgatttatgaggccactaagcgaccctcaggtctttctaatcgcttctctggctccaagtctggcaacnccggcctccctgacaatctccgtggggcctcgacggctacggacgacgaggacttaaattacttactcgctgcttcaattagtaggtaaaggtttaataaactactaacttacgttaagttcgggacgggaacggggtaaccaaaggaccgttacggaccccggttccgttcgggaccgttaccgaccggtaccccgaaacgggtcccgtacccggtcccccccgttccggggttaccctaccccggtttcccttcccgggtttccccccgacccccttccccggttacccgtacccgttaaccggtaacgtaacccgtggggtaaccggccgggggtaccgtacggggaccgaaaccgggg

SEQ ID NO: 328331 - DNA, 526 bp, Homo sapiens
  misc_feature: GZ8MTXP02GQ4BI.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcaggctttctaatcgcttctctggcctcaagtctggcaacacggcctcctgacaatctcctggctcaggctgacgcgagctaaattatactgctgctcatatagtaaagttaataaacactaatactagttcggcggaagggaccaaagctagaccgtcctagccgtcacgcccgaaggctccgccccctcggtcaccttctcgttccccgccctcctacgcttacgaacgactgacgcggctggacaacgg

SEQ ID NO: 328332 - DNA, 515 bp, Homo sapiens
  misc_feature: GZ8MTXP02FT05P.15.1.A01.1.454.CMB.2.raw
  modified_base (483)..(483): a, c, t, g, unknown or other
  misc_feature (483)..(483): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggtatcaccttgtctcctggtaccaacaccaccccggcagagcccccaaactcatgatttatgaggccactaagcgaccctcagggctttctaatcgctttctctggctccaagtctggcaacacggcctccctgacaatctcctgggctccaggctgacgcgaggctaaattattactgctgctcatatgaaggttataaacactatactattacggcgagggaccaaagctgaccgtctgcgtcagcccaaggctcgccccctcggtcactctcgttcccgcccttccncgctacgtaagactggacgcggctcggcaagg

SEQ ID NO: 328333 - DNA, 506 bp, Homo sapiens
  misc_feature: GZ8MTXP02GABWJ.15.1.A01.1.454.CMB.2.raw
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcacgacgcccccaaactcatgatttatgaggccactaagcgaccctcagggtctttctaatcgctttctctggctcaagtctggcaacacggcctccctgacatctctggctcagctgacgcgagctaattattactgctgctnatatgtaagttataacactatactagtcggngaggaccagctgaccgtctgcgtnacgccgaaggcctcgcccctcggcactctcttacccccncctccncgctacgtaagcgcgcggcggcgcgacgacg

SEQ ID NO: 328334 - DNA, 541 bp, Homo sapiens
  misc_feature: GZ8MTXP02JVRQG.15.1.A01.1.454.CMB.2.raw
tcagtctacgtagccacgaccggtgctcgatttagacgtctcatcaggtcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaaagccgaccctcagggctttctaatcgcttctctggctccaagtctggcaacacggcctccctgacaatctcctgggctccaggctgacggcgaggctaattattactgctgctcatatgtaaggttataacactatactagttcggcggagggaccagcgtgaccgtcctgcgtcacgcccgaaggcctccgccccctcggtccacctctccgttccccaccctccgtccgacctacgtaacgacgtcggacggcggggctcgggacaacggg

SEQ ID NO: 328335 - DNA, 544 bp, Homo sapiens
  misc_feature: GZ8MTXP02JK59O.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggggttatcaccttgtctcctggtaccaacaccaccccggcacgagcccccaaactcatgatttatgaggccactaaagcgaccctcagggctttctaatcgctttctctggctccaagtctggcaacacggcctccctgaccaatctcctgggctccaggctgacgacgaggactaattattactgctgctcatatgaaggttataaacactaatactagttcggcgggagggacccaaaggctgaccgtctgcgttcagcccaaggcctgccccctcgggtccacttccgtcgttccccggcccttcctccggcttacgaacgacctggacgtcggggctacgggcaaacgg

SEQ ID NO: 328336 - DNA, 525 bp, Homo sapiens
  misc_feature: GZ8MTXP02JQPVQ.15.1.A01.1.454.CMB.2.raw
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (430)..(430): a, c, t, g, unknown or other
  misc_feature (430)..(430): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagccgaccctcagggctttcaatcgcttctctggctcaagtctggcacncggcctccngacatctccgtggctcaggctgacgcgagactaatttatctgctgctcatatagaagttataaacactaatactagttcggacggagggacaagctcgaccgtccngcgtcacgaccgaggcctcgccccgtcgtccacgtctaccgttccccaccctcctcgacctacgtaacgactggacggcgggctcggacaacggg

SEQ ID NO: 328337 - DNA, 614 bp, Homo sapiens
  misc_feature: GZ8MTXP02GLBKQ.15.1.A01.1.454.CMB.2.raw
  modified_base (374)..(374): a, c, t, g, unknown or other
  misc_feature (374)..(374): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttatgaggccactaagcgaccctcagggctttctaatcgcttctctggctccaagtctggacaacaccggcctccctgacaaatctcctgggctccagctgacgacgagactaaattattacgnctgctatatagtagtaaagttaataaactacttaactaacgtagtacgggacgggaacgggaaccaagtccgtacgacccgttccgtcgacccgtaccgaaccggaccccgaacggtcccgtaccccggtcccccgttaccggtaccctacccgttccgttccccgttcccccgtccccttcccgtccgtaccgttaacgtaacgtacgtcggacgggccgggacgtacggacgaacggg

SEQ ID NO: 328338 - DNA, 622 bp, Homo sapiens
  misc_feature: GZ8MTXP02HE7CW.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacaccacccggcacgacgaccccaaactcatgtattatgaggccactaacgccgaccctcgacggtcctttactaatccgtctttcctctcggcctccaagtctggaccaaccgaccggccctcccctagacctaatcctccgtcggggccctaccgaggtcctaggaccggacggaaggtacctttaaatttacttaaccgttgcttcgctacaattagtagtaaagttaataaactacttaataacgttagtcgggacggaacgggaccaagcgtcgacccgtcgtcgccgtacgacgacccgaaggcctccgtccccctcggtacctacgttcccttccgtcccccacccttcccgccgtaccttacgtaacgtacgtcggacggcggcgtacgggacacgg

SEQ ID NO: 328339 - DNA, 578 bp, Homo sapiens
  misc_feature: GZ8MTXP02ICD33.15.1.A01.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (574)..(578): a, c, t, g, unknown or other
  misc_feature (574)..(578): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtggaccacatactacgcagattccgtgaagggcagattcaccatctcagagacaattggagaacaccgtgattcttaaanatgaacngcctagagagccgatgacacgctgtgtatttcngtgacgagaaggtacgggtaataagttagttacgtggtttcggccagtcggggaccaggggaccctggtacagtcgtctcgtcacgccctaccaaccgaaggccccacgtccggtcccttcccccgtcggtcccaccccttccctaccaacgacgccaccgtcgtcgggggccacgacggtccggcccgtcgggctcggaccgtcggaccgaacgtacctaccgttcccgacgtacgtaacggcgtagacggccggtcgcggaccgaaggcgacagtacgnnnnn

SEQ ID NO: 328340 - DNA, 514 bp, Homo sapiens
  misc_feature: GZ8MTXP02JHDQ1.15.1.A01.1.454.CMB.2.raw
  modified_base (319)..(319): a, c, t, g, unknown or other
  misc_feature (319)..(319): n is a, c, g, or t
  modified_base (474)..(474): a, c, t, g, unknown or other
  misc_feature (474)..(474): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagtgaccctcagggctttctaatcgctttctctggctccaagtctggcaacncggcctccctgacaatctcctggctccaggctgacgcgaggctaattattactgctgctcatatagaagttataacactatactattcggcggaggaccaagctacgaccgtctgcgtcacgcccaaggctcgcccctcggtcactctcgtcccnccctcctcgctacgtaagcgtagacggcggctggcaacgg

SEQ ID NO: 328341 - DNA, 613 bp, Homo sapiens
  misc_feature: GZ8MTXP02GQF2V.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgggggggtccctgagactctcatgtgcaggctctggattcagcgtcaggaatagtacatgagttggtccgcaggctccgagggcaggggctaggagtggctctcaatgatttacaccggtagtcggggacgtgggaccacatactacgcagattccggtagaagggcagattcacatctaccagagactaagttggaacaacaccgtagaatttcttaaatatagaacacggtaccctaggaacgacggacccgtaagtacggaaccgacgggtcttaggttacggtttaattttccgtaggttcggacgtaaacggtaggtaaaccggggttaattaaacgttaggtttaaccgttggggtttacggacccgtacggttaacccggggg

SEQ ID NO: 328342 - DNA, 538 bp, Homo sapiens
  misc_feature: GZ8MTXP02JAV9J.15.1.A01.1.454.CMB.2.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggtctttctaatcgctttctctggctcaagtctggcaacacggcctcccngacatctccnggctcaggntcgacgcgaggctaattattactgctgctcatatagaagttataacactatactagttcggcggaggaccaagcgtacgacccgtctgccgtcacgcccaaggcctcgccccctcggtccacgttctcgttcctcctaccctcccgtccgtaccgtaacgttacgacttcggacggtcgggcgtcggaacg

SEQ ID NO: 328343 - DNA, 520 bp, Homo sapiens
  misc_feature: GZ8MTXP02HUD1O.15.1.A01.1.454.CMB.2.raw
  modified_base (286)..(286): a, c, t, g, unknown or other
  misc_feature (286)..(286): n is a, c, g, or t
  modified_base (381)..(381): a, c, t, g, unknown or other
  misc_feature (381)..(381): n is a, c, g, or t
  modified_base (453)..(453): a, c, t, g, unknown or other
  misc_feature (453)..(453): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggagcttggtccaggccggggggtccctgagactctcatgtgcaggctctggattcagcgtcaggatagtacatgagtggccncaggctccgagggcaggggctagagtgctctcaatgatttacacgatcggggacgtggacacatacagcagatccgtgaagggcagatcacatcncagagacaatttggaagaacacgtgaatttctaaatattagaacagaccctgaagagccgatcgaacgcggngtcgtagtattcgtgttcgcgacgagaggtaagtaagtaagttacgtagttcgtcgtacgtacgggg

SEQ ID NO: 328344 - DNA, 510 bp, Homo sapiens
  misc_feature: GZ8MTXP02JEIDX.15.1.A01.1.454.CMB.2.raw
  modified_base (294)..(294): a, c, t, g, unknown or other
  misc_feature (294)..(294): n is a, c, g, or t
  modified_base (474)..(474): a, c, t, g, unknown or other
  misc_feature (474)..(474): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcacgacgcccccaaactcatgatttatgaggcactaagcgaccctcaggctttctaatcgctttcnctggctccaagtctggcaacacgcctccctgacatctctggctcagctgacgcgagctaattattactgctgctcatatagtaagttataacatatactatcggagagggaccaagctgaccgtcgtgcgtcacgcccgaaggcctcgccccctcggtcacttctccgtcccaccctccncgctacgtaagacgtgacggcggactcggacaacgg

SEQ ID NO: 328345 - DNA, 552 bp, Homo sapiens
  misc_feature: GZ8MTXP02IU4MD.15.1.A01.1.454.CMB.2.raw
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
  modified_base (552)..(552): a, c, t, g, unknown or other
  misc_feature (552)..(552): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattctaaatatgaacagcctgagagccgatgacacggctgtgtatttcngtncgagagacggtataatagttactggttgcacgtcggggccagggaaccctggtcatcgtctcgtcagcctccacaaacgggcccatcgtcctcccctgccaccctcncccaagcncaccncgtgggcgacacgcgcccgtcgggcgtcgccgtcggtacgaaacggaacgttaaccttcccgtactaacccgttaagaaaccggtacggacggacgggcggtacggacggaacggaacgacgacgtacgncnncn

SEQ ID NO: 328346 - DNA, 525 bp, Homo sapiens
  misc_feature: GZ8MTXP02JIDTI.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcaggctttctaatcgctttctctggctccaagtctggcaacacggcctcccctgacaatctcctgggctccaggctgacgcgaggctaaattattactgctgctcatatgaaggttataacactatactattcggcggagggaccaagctagaccgtctgcgtcagcccaaggcctcgccccctggtccacgtctcgtccccgccctccctacgcctacgtaacgacctggacggcgggactcggcaacgg

SEQ ID NO: 328347 - DNA, 587 bp, Homo sapiens
  misc_feature: GZ8MTXP02H1GRQ.15.1.A01.1.454.CMB.2.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (584)..(587): a, c, t, g, unknown or other
  misc_feature (584)..(587): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccgtgaaggcagattcacatctcagagacaattgganaacaccgtgattcttaanatgaacagcctgagagccgatgacacggctgngttattttcgngngngagagacggtataagtagtagtggttcgcaggtcggggaccgaacgggaccctggtacagttcgtctcgtacaccgccctaccgaaccgaacggccctacgtcccgtcccttcccccgtcgaccctacccctccctaccgaacgacgacccgtaccgtcggtacggggaccacgacggcccggtcccgtcgggccgtcggccgtacggtacgaacggtaccttaccgtaccgtacgtaacgtacgacgtcggacggcggcgacggacgaacggcgacgacgacgannnn

SEQ ID NO: 328348 - DNA, 585 bp, Homo sapiens
  misc_feature: GZ8MTXP02GNU66.15.1.A01.1.454.CMB.2.raw
  modified_base (430)..(430): a, c, t, g, unknown or other
  misc_feature (430)..(430): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcagacgcccccaaatcatgtatttatgaggccactaagccgaccctcgaggtctttactaatcgctttctctggcctccaagtctcggacaacaccggcctccctgactaatctccgtcgggcctcaggctgacgacgaggacttaaattattactgtctgctacatatagtaaagttataaacactaatactagttacgggnggaacggaccaagcgtacgaccgtcgcgcgtacacgtcccaagggcctccggcccccgtcggtcctacttcctccgtttacccccaccctttcctccggaccttaacggtaacgtaacccgtggaacggtccgggacgtcggggacccgaacggg

SEQ ID NO: 328349 - DNA, 506 bp, Homo sapiens
  misc_feature: GZ8MTXP02GYOB6.15.1.A01.1.454.CMB.2.raw
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
  modified_base (487)..(487): a, c, t, g, unknown or other
  misc_feature (487)..(487): n is a, c, g, or t
  modified_base (502)..(506): a, c, t, g, unknown or other
  misc_feature (502)..(506): n is a, c, g, or t
tcagtctacgtagccacgaccggtgctcgatttagacgtctcatcagggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattgganaacaccgtgattcttaatatgaacagcctgagagccatgacacggctgtgtatttcngtgcgagagacggtataaatgttacnggtttgccatcggggccagggaaccctggtcatcgtctcgtcagcctccaccaagggcccatcgtcttccccctggcaccctcctccaagacgcacctcgtcgggggcacgacgcggccctggggctgccctggtcaacggctacttcgctacgtacgactcgagcggcncgcaaggcgcatagnnnnn

SEQ ID NO: 328350 - DNA, 521 bp, Homo sapiens
  misc_feature: GZ8MTXP02JCRP4.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgccccccaaactcatgatttatgaggccactaagcgaccctcagggctttctaatcgctttctctggctccaagtctggcaacacggcctccctgacaatctctgggctcaggctgacgcgaggctaattattactgctgctcatatgaaggttataacactatactattcggcggagggaccaagctgaccgtctgcgtcacgcccaaggcctcgcccccgtcggtccacttcctcgttccccgccctcctcgctacgtaagacctggacgcggctcggcaacgg

SEQ ID NO: 328351 - DNA, 660 bp, Homo sapiens
  misc_feature: GZ8MTXP02IJ4ZR.15.1.A01.1.454.CMB.2.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaattgganaacaccgtgattcttaaatatgaacagcctgagagccgatgacacggctgtgtattttcngtgcgagaggacggtaataagttagttacgttggtttcggacctacggtcgggggacccaaggggtaacccccttggtactattccgttctccgttacacgtccccctaccccgaaccgaaacggggcccccaacgtccggtccccttcccccgtcggccctaccccctccctacccgaaacgtaccgaccgacccgtccggtacgggggccaccgacggccccggccccggtggggcccttcggccgttcgggtaccgtaaacgggtaccctttaccgttacccgtaccgttaaccggttaacggaccgttacgggaacgggccggggtacgtcggacgaaacggccgacgacgtacgncncnn

SEQ ID NO: 328352 - DNA, 521 bp, Homo sapiens
  misc_feature: GZ8MTXP02I9HE8.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaaagcgaccctcagggtctttctaatcgctttctctggctccaagtctggcaacacggcctccctgacaatctcctgggctcagctgacgcgagctaattattactgctgctcatatagaaggttaataactactatactagttcggcggaaggaccaagcgtagaccgtctagcgtcgacgcccaaggcctcgccccctcggtcacgtctcgtacccacctcctcgctacgaagactcgacgcggctcggcaacgg

SEQ ID NO: 328353 - DNA, 523 bp, Homo sapiens
  misc_feature: GZ8MTXP02I7QYE.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttctctggctccaagtctggcaacacggcctccctgacaatctctgggctcaggctgacgcgaggctaattattactgctgctcatatagtaaggttataacactatactattcggcggagggaccaagctgacccgtctgcgtcacgcccgaaggcctcgcccccgtcggtcacgtctcgttcccaccctcctcgctacgtaacgactcgacggcggctcggacaacgg

SEQ ID NO: 328354 - DNA, 562 bp, Homo sapiens
  misc_feature: GZ8MTXP02HG6RM.15.1.A01.1.454.CMB.2.raw
  modified_base (255)..(255): a, c, t, g, unknown or other
  misc_feature (255)..(255): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttangaggccactaagcgaccctcaggctttcaatcgcttctctggctccaagtctggacaacgacgcctccctgacaatcncctgggctcnggctgacgcgagataaattatactgctgctcatatagaagttaataacactatactagttcggacggtaggacctaaagcgttacgaccgtcctagccgtacacgacccgaacggtccgtaccgcccccgtcggtaccctaccttccgttccggtcccccgtcccctccgtccgtccgtaccgttaacgaccgtcggacggcggccgtcggacgaacgg

SEQ ID NO: 328355 - DNA, 605 bp, Homo sapiens
  misc_feature: GZ8MTXP02GIWQN.15.1.A01.1.454.CMB.2.raw
tcagtctacgtagccacgaccggtgctcgatttagacgtctcatcagggggggagaggagcctagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccaggccggggggtcctgagactctcatgtgcaggctctggattcagcgtcaggatagttacatgagttgggtccgccgaggctccgaggggcgaggggctaggagtggctctcaatgtatttacaccgagtcggggacggtgggaccacatactacgcagtattccggtagaaggggcaaggtacttacacctaactcctacccgaagaacgaactaagtttgggaacgtaaacgacccgttagtaactttacttaaatacgtagaacagccgtagacgagaccgagtgacgacgggtctcggttgttatttcgtaggttcggacgtaggtaaggtacgggttaataacgttaaggtttacgtgggtttacggcctacggtaccggggg

SEQ ID NO: 328356 - DNA, 601 bp, Homo sapiens
  misc_feature: GZ8MTXP02G9FNR.15.1.A01.1.454.CMB.2.raw
  modified_base (255)..(255): a, c, t, g, unknown or other
  misc_feature (255)..(255): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
  modified_base (462)..(462): a, c, t, g, unknown or other
  misc_feature (462)..(462): n is a, c, g, or t
  modified_base (588)..(588): a, c, t, g, unknown or other
  misc_feature (588)..(588): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccacccggcagacgccccaaactcatgatttangagcactaagccgaccctcgaggtctttcaatcgtcttctctggctccaagtctaggccaaccgaccggcctccctagacaatctccgtgggcctccgaggctaggacgcggagtacttaaattattacngctcgcttacatagtagtaacgttaanaactactatactagttcggacggaaggacccaaggcctacgcccgttcgngtaccgtcgaccggacccgaacgggtccctcccgcccccgttcggttaccacccgtttcctcccggtttacccccacccgttccctacggtccttaacgtaaccggacttcgggacgtccgggacncggaccgaacggg

SEQ ID NO: 328357 - DNA, 729 bp, Homo sapiens
  misc_feature: GZ8MTXP02G9H5U.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgcttattttaaaaggtgtccagtgtgaggtgcagctggtggagtcgtgggggaggcgttgggtccgagggcccgggggggtccctggagactctcatggtgcaggctcgtggtattcgagcgtcaggaatagtacagtgagttggtccgcaggctccgagggcgaggggctaggaggtggctctcaatgactttaccgacggtagtcggggacgtcgggaccacgactacgtacgcgtagacgtttccggagaaacgggcctaggaactttacccaccgtaaacttcctaacccgaagaacgtaacgttaaacgtttagggaaacgtaaaccgacccggttagtaaacttttacctttaaaagttagttacggaaaaccttacgggacccgttaggaaccggacggtacccggaagttaccggaaaccgtaacgggtctttaggggttacctttaaagtttccggttagaccggtacgggaaacggttaagggtaaaccggggttaaagtttaaaggtttaacggtttaaccgttggggtttaccggacccgttaacgggggttacccggggg

SEQ ID NO: 328358 - DNA, 674 bp, Homo sapiens
  misc_feature: GZ8MTXP02GGAO2.15.1.A01.1.454.CMB.2.raw
  modified_base (383)..(383): a, c, t, g, unknown or other
  misc_feature (383)..(383): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccggggggtccctgagactctcatgtgcaggctctggattcagcgtcaggatagttacatgagttggtccgccaggctccaggggcaggggctaggagtggctcgcaatgatttacaccgtagtcggggacgtgggaccacatacctacgcagacttccggngaaaggggcaagacttccgacctatcctacccaagacgaactaagttttagggaacgtaaaccgtaccgttggtaaactttacctttaaaattaattacggaaaacacgggtaccctaggaaggaacggacccgaagttcggaacgacggggtcttacgggttcgtttaaattttccgttaggttcggtacgggaacggtaaagggtaaccgggggtttaaattaaaaggtttaacggtttaccggtttagggggttttaccggtacccggtaacgggtttacccgggggg

SEQ ID NO: 328359 - DNA, 637 bp, Homo sapiens
  misc_feature: GZ8MTXP02G4JZC.15.1.A01.1.454.CMB.2.raw
tcagtctacgtagccacgaccggtgctcgatttagacgtctcatcagggcgtgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcagacgccccaaactcatgatttatgaggccactaagcgaccctcaggctttcaatcgcttctctggctccaagtctggcaaccgaccggcctcccgtgaacaatctccgtggggcctccgaggcctaggaccgacggacggtacttaaattattactgtctgctactattataggtaaagttataaactacttaatactagttcgggacgggtaagggaccaagctacggtacccgtcgttacggaccgtttacggacccccgtaaagggccctttcccggaccccccgttcgggtaccctaaccgttcccgttcccggttaccccccacccccgtttcccgtcccggaccttaaccggacgtaaccgtcggaacgggtccgggggctacggggaccaaacggggcccg

SEQ ID NO: 328360 - DNA, 602 bp, Homo sapiens
  misc_feature: GZ8MTXP02HPMCN.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcagacgaccccaaactcatgtatttatggacggccaactaacgccgacccctcgagggtctttactaatcgtcttctctggctccaagtctggacaacaccggcctccctagacaatctccgtgggcctcaggctggacgacgaggtcttaaattattactgcttgctcaatatagtaaagttaataaactactaatacgtagttcggaggaacgggaccaaagctacgaccgttcgagtcgacacgacccgaaggtcctccgtcccccgtcggtccaccgtttcccgtccgttcccccggaccccttcccgtccgtaccgtttaacggaacgttacgtacggacgggccgggacgtcgggacgaaccgggg

SEQ ID NO: 328361 - DNA, 648 bp, Homo sapiens
  misc_feature: GZ8MTXP02JKIXN.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctggggtctcctggacagtcgatcaccatctcctgcactggaaccagcagtgatggttgggggttatcaccttgtctcctggtaccaacaccgaccccggcacgacgccccaaactcatgatttatgacggccactaagcgaccctcgaggtctttctaatccgtctttctcgtggcctccaagtctggacaacacggccctcccagacaatctccgtggcctcgaggctgacgacgaggtacttaaattacttactgctgcctacattaagtagtaaagtttaactaaactacttaataacttagttaccgggacggtaaacggggacctaaaggccgtacggaccccgttccgtacggtccgtaccgaacggccccgtaaagggtcccttcccggtccccccgttacgggttccctacccgtttaccgttcccggttaccccctacccgttcccgtaccgtaccgtaacggttaacgaccgtcggacggtccgggcgttacggacgtaacggg

SEQ ID NO: 328362 - DNA, 569 bp, Homo sapiens
  misc_feature: GZ8MTXP02INIH3.15.1.A01.1.454.CMB.2.raw
  modified_base (472)..(472): a, c, t, g, unknown or other
  misc_feature (472)..(472): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctcctgtaccaacaccaccccggcacgacgccccaaactcatgatttatgaggccactaagccgaccctcgaggtctttctaatcgctttctcgtggcctccaagtctggccaaacgaccggccctcccctagacaaacttcctccgtcgggcctcccgaggctggacgacgaggtacttaaattattactgtctgctacatataggtaaaggtttaataaactactaatactagttcggacggaggaccaagctgacccgtcgngcgtcacgcccagggcctccgcccctcggtcaccgttcgtccctcccacccttcccgtccgtctacgaacgcgtacggcggcggctcggacgaacgg

SEQ ID NO: 328363 - DNA, 558 bp, Homo sapiens
  misc_feature: GZ8MTXP02JT3J8.15.1.A01.1.454.CMB.2.raw
  modified_base (512)..(512): a, c, t, g, unknown or other
  misc_feature (512)..(512): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgccccaaactcatgatttatgaggccactaagccgaccctcagggctttctaatcgctttctctggctccaagtctggcaacacggcctcctgacaatctcctcgggctccgaggctagacgcgaggctaattactactgctgctacatatagtaagttataactactatacgtagttcggcggtaaacgggacaaacggctacgacccgtccgtgccgtacacggcccaagggcctccggccccctcggtcctcctctccgttccccacccttcccncgtacctaccgtaaggacctcggacggccggtcgtcggacgaacgg

SEQ ID NO: 328364 - DNA, 528 bp, Homo sapiens
  misc_feature: GZ8MTXP02G27SJ.15.1.A01.1.454.CMB.2.raw
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
  modified_base (525)..(528): a, c, t, g, unknown or other
  misc_feature (525)..(528): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaaatatgaacagcctgagagccgatgacacggctgtgtatttcngtgcgagagacgggtataatagttactggtttgccagtcggggaccagggaaccctggtcatcgctcgtcagccctccaaccgaacgggcccagtccggtccttcccccnggccacctccctcccaacgacgcacctcgtcgggcggaccagcgccgcggtcgcgtcgcgtgacgacgtactcgtcgacgtacgactcgcggacggtcgcgtcgacgaacgcgactagannnn

SEQ ID NO: 328365 - DNA, 541 bp, Homo sapiens
  misc_feature: GZ8MTXP02J36TW.15.1.A01.1.454.CMB.2.raw
  modified_base (280)..(280): a, c, t, g, unknown or other
  misc_feature (280)..(280): n is a, c, g, or t
  modified_base (365)..(365): a, c, t, g, unknown or other
  misc_feature (365)..(365): n is a, c, g, or t
  modified_base (485)..(485): a, c, t, g, unknown or other
  misc_feature (485)..(485): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcacgacgcccccaaactcatgtatttatgaggccactaagccgaccctnaggctttctaatcgcttctctggctccaagtctggcaacacggcctccctgacatctctggctcaggctgacgcgagcttaattnttactgctgctcatatagaaaggttataaacactatactacgttcgggacggagggaaccaaacggcttcgacccgtcctgccgtcacgcccgaacgggccttccgcccccttcggtccncttccttcgttcccccgccctaccctcgctacgtgacgtgcgcggcgcgcgaacgg

SEQ ID NO: 328366 - DNA, 541 bp, Homo sapiens
  misc_feature: GZ8MTXP02IU9P7.15.1.A01.1.454.CMB.2.raw
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (468)..(468): a, c, t, g, unknown or other
  misc_feature (468)..(468): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccggggggtccctgagactctcatgtgcaggctctggattcagcgtcaggaatagttacatgagttgggtccgccgaggctccagggcaggggctaggagtggctctcaatgatttacaccggtagtcggggacggtggaccacatacgacgngagactccgtgaagggcagatcacanctacagagacatttgaacgaacaccgtgattacttaatactagaacagccgtagacgagccgaatgacncggctgtgttattcgtgtcgtcgagagacggtaagtaacgttagttacgtggtttcggaccgtacgtccgggg

SEQ ID NO: 328367 - DNA, 512 bp, Homo sapiens
  misc_feature: GZ8MTXP02GLMBC.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgctttctctggctccaagtctggcaacacggcctccctgacatctcctgggctcaggctgacgcgagctaaattattactgctgctcatatgaaaggttataacactatactagttcggcggagggaccaagctgaccgtctgcgtcacgccaaggctcgcccctcggtcactctcgtcccgccctcctcgctacgtaagactgacggcggctcggcgaacgg

SEQ ID NO: 328368 - DNA, 548 bp, Homo sapiens
  misc_feature: GZ8MTXP02GLI4Z.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcaggtctttctaatcgcttctctggcctccaagtctggcaacaccggcctccctgacaatctcctggctcgaggctgacgacgagacttaattattactgctgctcatatagaagttataaactactaatactagttcggacggtacggacaagctgacccgtcgtgcgtcgacgacccgaaggcctcgtccccctacggtctaccgtcctccgttccccgcccttccctcgccgtacgtaacgacgtcgacggtcggacgtcgggacaacggg

SEQ ID NO: 328369 - DNA, 511 bp, Homo sapiens
  misc_feature: GZ8MTXP02FGOFB.15.1.A01.1.454.CMB.2.raw
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (504)..(504): a, c, t, g, unknown or other
  misc_feature (504)..(504): n is a, c, g, or t
  modified_base (507)..(511): a, c, t, g, unknown or other
  misc_feature (507)..(511): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggntgtgtattctgtgcgagagacgggtataatagttactggttggccacgtggggccagggaccctggtcatcgtcncgtcagcctccacaaggcccatcgtcttccccctggcaccctcctcccaagacgcacctctgggggcacacgcggcccctggggctcgcctcggtcaacggactacttccgctacgtagacgtcgagcggctcggccaaggcgcanagnnnnn

SEQ ID NO: 328370 - DNA, 624 bp, Homo sapiens
  misc_feature: GZ8MTXP02G33V3.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggggttatcaccttgtctcctggtaccaaacaccacccggcacgacgacccccaaactcatgtatttatgaggccactaaagccgaccctcgaggtctttactaatcgctttctctggctccaagtctggcaacacggcctccgtagacaactctccgtcgggcctccgaggtctacggaacgacgtaggtacttaaattattactgcttagctacaattagtagtaaaggttaactaaaacacttaataacgtagttcgggacggaaacgggactaaagcttacggaccgtcgtgaccgacaccgacccgaaggtcctcccgcccccgttcggtcctacccgtttccgtcccggttccccctccccttaccgtaccggtactaaccggggttaacaaccgttggacggccggggctacgggaccgaaacggg

SEQ ID NO: 328371 - DNA, 756 bp, Homo sapiens
  misc_feature: GZ8MTXP02F1BLN.15.1.A01.1.454.CMB.2.raw
  modified_base (340)..(340): a, c, t, g, unknown or other
  misc_feature (340)..(340): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggaggtcgtgggggaggtcttggtccgagggcccgggggggtccctggagactctcatgtgcgaggctctggattcaggcgtacaaggaatagttacagtggaggttcgggtcccgccgaggcctccgagggcgaggggctaggngtggctctacaatgattaccgaaccggtaggtcgggggacggtcgggaaccaacataccgacgctaagtacttccggaggaaggggctaagtacttaccgaccctatcctaccaagagtaaactaagtttacggaaacgtaaccgtaccgtagttaaactttaaccgttaaaattaagttaacgtaaacgtacggtacccgttaaggaacggaacggacccgtaaagttaccggaaaccgtacccggggttcgtttacggtttacggtttaagtttttccggttagggttacggtaccgggtaaaaggggtaacggggttaaaaccggggtttaaaagtttaaaacggttttaacggttttaaaccggggtttcggggttttaccggtacccgggttacggggttaacccgggggg

SEQ ID NO: 328372 - DNA, 524 bp, Homo sapiens
  misc_feature: GZ8MTXP02GKMYG.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagccgaccctcagggctttcaatcgctttctctggctccaagtctggcacacggcctccctgacatctcctggctcagctgacgcgagctaaattattactgctgctcaatatagaaggttataaacactatactagttcggacggtaggaccaaagctgaccgtcagcgtcagcccaaggctcgcccctcggtccactctcgttccccaccgtcctcgactacgtaagaccgtggacgcgggctacgggacaacggg

SEQ ID NO: 328373 - DNA, 714 bp, Homo sapiens
  misc_feature: GZ8MTXP02GS23V.15.1.A01.1.454.CMB.2.raw
  modified_base (256)..(256): a, c, t, g, unknown or other
  misc_feature (256)..(256): n is a, c, g, or t
  modified_base (337)..(337): a, c, t, g, unknown or other
  misc_feature (337)..(337): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctctggtaccaacaccaccccggcacgacgaccccaaactcatgatttangaggccactagccgaccctcacggtctttactaatccgtctttctctcggctaccaagtctggacaaccgccggcctcccngacaacttctccgtcgggcctccgaggcgtacggaacgacggtacggtactttaaagtttacgttaacgtggtcttcggtacttacgtaaagtttaacgtaaggttaaaacggtttaaactaaacctaactttaactttaaaccgttaagggtttaccggggaccggggaaacggggtaaccctaaacggccggtttaccgggacccgtttccgtcgggtaaccgttaccggaaccgtaccccgaaagggtccccttaccccggtcccccgttccgggtaccctaacccgttccgttccccgtttacccccacccgtccgttccgaccgtttacggaacgtcgttacggcgggtccggtacggcggacgaaccgggg

SEQ ID NO: 328374 - DNA, 697 bp, Homo sapiens
  misc_feature: GZ8MTXP02H8RCQ.15.1.A01.1.454.CMB.2.raw
  modified_base (267)..(267): a, c, t, g, unknown or other
  misc_feature (267)..(267): n is a, c, g, or t
  modified_base (610)..(610): a, c, t, g, unknown or other
  misc_feature (610)..(610): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctaccttgtcctccgtcggtaaccaaccacccgacccgcacgaccgaccccaaactcatgtattagnggacgaccaacgtaacgccgtaccctacggacggtctttactaactccgtcttccttcgtcggcctaccgaagtcgtacggacaaccgtaccggtccctccctagtaaccacgttcgtcccgtcgggtaccctaccgaggtcgtaacggaccgacgggtagttaacttaaactttagttacctggccttcgacttacaagttaacgttaaggtaaacgttaactaaactaacttaattacgtaaggttccggggaacggaacggtaacgaacggtcttaaccggcccgttccgtgaccgtacgaccgacccgtaaggcccgtccccgtccccggtcgttaccncgtttccctcccgttaccccctcccttcccgtacgtaccgttaacgtcgtacggtcggacggggccggtcggtacggaccggtacgg

SEQ ID NO: 328375 - DNA, 587 bp, Homo sapiens
  misc_feature: GZ8MTXP02HBPAP.15.1.A01.1.454.CMB.2.raw
  modified_base (230)..(230): a, c, t, g, unknown or other
  misc_feature (230)..(230): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggnagacgcccccaaatcatgatttatgagccactaagcgaccctcgaggtcttctaatcgtcttctctggctccaagtctaggcaaccacggcctccctgaacaagtctccgtgggcctcgaggctagaacgcgaggtactaaatttactactgctagctacattagtagtaagttaataactaactataactagttacgggacgggtaaagggacctaaacggcgtacgtacccgtccgtcgccgtacgacgacccgaacggtcctccgtccccccgtacggtccaccttccttccgttccccgtccctcccgtccgccttaacgtaacgacgtacgacggcggcgcggacgaacggg

SEQ ID NO: 328376 - DNA, 641 bp, Homo sapiens
  misc_feature: GZ8MTXP02JK5WK.15.1.A01.1.454.CMB.2.raw
  modified_base (252)..(252): a, c, t, g, unknown or other
  misc_feature (252)..(252): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccacccggcacgacgccccaaactcatgattangagaccactaagcgaccctcgacggtctttactaatcgtctttctcgtcggcctaccgtaacgtcgtggaccaacgaccggtccctccctagactaactctccgtcgggtcctccgaggctaggacgacgacggtacttaagttacttactgtctcgctacaattagtagtaagttaactaacacttatacgttagtcgggacggaacgggtaccaaaggtcctacgtaccgtacgtcgaccgtcgacggacccgtaagcccgtcccgtacccccgtcggtacctaccgttccgttccccgtttccccgccccgtttcccgacccggtacgttaaccggaacgttaacccggggtcgggtaccgggtccgggtacgtacgggacgacgg

SEQ ID NO: 328377 - DNA, 547 bp, Homo sapiens
  misc_feature: GZ8MTXP02JFT9M.15.1.A01.1.454.CMB.2.raw
  modified_base (517)..(517): a, c, t, g, unknown or other
  misc_feature (517)..(517): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgccccccaaactcatcgatttaatgagtccactaaagccgaccctcgacgggctttacaatccgctttctcgtggctccaagtctggacaacacggcctccctgacaatctcctgggctccaggctgacgcgagctaatatactgctgctcatatgaaggttaataacacttaatacgtaagtcggacggaggaccaaggctagacccgtctgcgtcacgccctaaggcctcgcccccgcggtactacctctccgtccccgcctaccgtcgcttaaaccggngtacgacggacggcggtcgacggacgaacg

SEQ ID NO: 328378 - DNA, 554 bp, Homo sapiens
  misc_feature: GZ8MTXP02GJXFD.15.1.A01.1.454.CMB.2.raw
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgcccccaaactcatgatttatgagccactaagccgaccctcaggtctttctaatcgcttctctggctcaagtctggcaacncggcctccctgacaatctcgtcgggctcgaggctgacgacgagactaagttatacngctgctctatatagaagttaataactactaatactagtacgggcggaaacgggaccaaagcgtacgaccgtacctgccgtcgacgacccgaaggcctccgaccccctcggtcctacctcctccgttccccgccctccctccgaccgtacgtaacgacgtcggacggcgggactcggacgaacgg

SEQ ID NO: 328379 - DNA, 576 bp, Homo sapiens
  misc_feature: GZ8MTXP02IIWB7.15.1.A01.1.454.CMB.2.raw
  modified_base (295)..(295): a, c, t, g, unknown or other
  misc_feature (295)..(295): n is a, c, g, or t
  modified_base (428)..(428): a, c, t, g, unknown or other
  misc_feature (428)..(428): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgcttattttaaaaggtgtccagtgtgaggtgcagctggtggagtcgtgggggaggcttggtccaggcccggggggtccctgagactctcatgtgcaggctctggattcagcgtcaggaatagttacatgagttcggccncgaggctccgagggcaggggctaggagtggctctcaatgtatttacacgtagtcggggacggtggaccagatactacgcagtacttccggtagaaggggcagtacttcacatctccgagagactagttggaanaacacgtatattacttaatatagaacagcctagagacgacgaagttagaaacgtcgttaggttacgttatttcgtgttagacggtagtaacggtaggtaattaaggttaagttacgttcgggttacgccgtacggtcggggaacccgg

SEQ ID NO: 328380 - DNA, 621 bp, Homo sapiens
  misc_feature: GZ8MTXP02JQE4V.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcagacgccccaaactcatgatttatgaggccataagccgaccctcgaggtctttctaatcgctttctctggtctcctaagtctggacaaaccgaccggccctcccctagacctaactctccgtgggcctccgaggctgacgcgagctaattatactgactcgctcaattagtacggtaaagtttaataaactacttaattaacgttaagttacgggacgggaaacgggaccaaagcgtacgaccgtccgtagcgtcacgcccgaacggccgtccgacccccgtcggttccacccgtttctcccggttccccctccccgttcccgtccgtaccgtaaccggttaacgtaccgttacgggtacggaccgggtccggttacgggaccgaaccgggg

SEQ ID NO: 328381 - DNA, 534 bp, Homo sapiens
  misc_feature: GZ8MTXP02FYUIK.15.1.A01.1.454.CMB.2.raw
  modified_base (355)..(355): a, c, t, g, unknown or other
  misc_feature (355)..(355): n is a, c, g, or t
  modified_base (466)..(466): a, c, t, g, unknown or other
  misc_feature (466)..(466): n is a, c, g, or t
  modified_base (524)..(524): a, c, t, g, unknown or other
  misc_feature (524)..(524): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagccgaccctcagggctttctaatcgctttctctggctccaagtctggcaacacggcctcctgacaatctcctgggctcaggctgacncgagctaaattattactgctgctcatatagaaaggttataaacacttaatacttagttacggcggaagggacccaaagctcgacccgtctgccgtcgacgcccgaacggcncgccccctggtccacgtctcgtcccacccgtcctcgctacgaagactcgacgcggtcncggacaacgg

SEQ ID NO: 328382 - DNA, 702 bp, Homo sapiens
  misc_feature: GZ8MTXP02G7XY1.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggagtcgtgggggaggcttggtccgagggccggggggtccctggagactcgtcatgtgcgaggctcgtggattcgagcgtcgaaggtaatagttacagtggtaggttcgggtccgccgaggcctacccggaggggcgaggggtactaggaggtcggcttctacgtaatcggtatttaccgaaccggtagtaccggggggacgggtacggggaccaacgtacttaaccgacgctaaggtacgtttcccgggagaaacggggtcaaggtacctttaccaacctactccgtaccgaagtacgtaaactaagtttacggggaaactaaaccgtacccgttagttaaactttaccttaaagtacgtagtaaaccgacggtacccgtagaacgtaacggcccgtaagtacgaaaccgtcgggtcttaggtacgtttatttaccgtggtacgtacgggaagtaggtacggtaattaaggttacgttacgtggtttaccgacgtacggtccgggg

SEQ ID NO: 328383 - DNA, 711 bp, Homo sapiens
  misc_feature: GZ8MTXP02GWXP5.15.1.A01.1.454.CMB.2.raw
  modified_base (585)..(585): a, c, t, g, unknown or other
  misc_feature (585)..(585): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctcctaggtaccaaccaccaccccggcacgaccgaccccaaactcatgtatttatgaggaccactaacgccgaccctacgaggtcctttactaactccgtctttcctcgtcggcctaccgtaagtcgtacggaccaaacccgacccggtcccttccccgtagaacctaaactccgtcccgtcggggtccctaccggaacggtccgtacggaacggtaccggggtaaggtacctttaaaatttaccgttacgtcgtccgttcgtccttagtaaagttagttaaggtaaaggtttaaactaaacgtaacttaagttaccttaagggttccggggacgggaaacggaccaaaggtcctacggcccttacgtcgccgtacncgtaccgacggtcctaccgtccccgtcggtacctcgttcctacccggttacccccaacccgttcccgtaccgtaaccgttacggtaacgtacgttacggggacggccgggtcgaacggacgaacgg

SEQ ID NO: 328384 - DNA, 607 bp, Homo sapiens
  misc_feature: GZ8MTXP02GCH7D.15.1.A01.1.454.CMB.2.raw
  modified_base (387)..(387): a, c, t, g, unknown or other
  misc_feature (387)..(387): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctcctggtaccaacaccacccggcagacgcccccaaactcatgatttatgaggccactaagccgaccctcagggtctttctaatcgctttctctggcctccaagtctggaccaacgaccggccctccctgacaactctccgtgggcctccgaggctagacgacgaggacttaaattattacngtctgctcatatagtaaagttaataactactatacgtattcggacgggacgggtaaccaaagtcgtacgtacccgtccgtcgccgtacgaccgacccgaacggccctcccggtcccccgttcggtacctacccgtttcctccggtttacccccacccgttcccgtaccgtccgttaaccgtaacgtaccgtacggacggccgggtcgtcggacgaacggg

SEQ ID NO: 328385 - DNA, 525 bp, Homo sapiens
  misc_feature: GZ8MTXP02IZJLO.15.1.A01.1.454.CMB.2.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (325)..(325): a, c, t, g, unknown or other
  misc_feature (325)..(325): n is a, c, g, or t
  modified_base (515)..(515): a, c, t, g, unknown or other
  misc_feature (515)..(515): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcacgacgccccaaactcatgatttangagccatagcaccnaggcttctaatcgcttctctggctcaagtctggcaacgcgcctccctgacatcnctggctcagctgacgcgagtactaattatacctgctgctcatatagaaagttataacactatactagttcggcggaaggaaccaagctgtacccgtccgtgcgtcgacgcccgaagccgtccgccccctcggtacaccttctaccgttccccacccttccgtcgtactacgtaagtcctggacgcgggcncggacacggg

SEQ ID NO: 328386 - DNA, 583 bp, Homo sapiens
  misc_feature: GZ8MTXP02J4VWK.15.1.A01.1.454.CMB.2.raw
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacacccaccccggcagacgccccaaactcatgtatttatgaggccactaagcgaccctcaggcttctatgctctctgctcagtctaggcacacggcctccctgacatctcctgggctcgaggctagacgcgaggactncttatctatcggttntctactntacgtataagttaagtaaacgttataaacttaacgtaacttacgtacgtaacggtaccggacgtacggacgacggtcgtacggtaccgtacgcgtaccgtacgtaccgccgtaccgtccgtcccgtcccgtaaccgtcccgtccgttaacccttccgtcccgtccctaacccgtcgtaccgtcgtacgtcggtacgacggtcgg

SEQ ID NO: 328387 - DNA, 717 bp, Homo sapiens
  misc_feature: GZ8MTXP02F1POF.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccaggccggggggtccctggagactctcatgtgcaggctctggattcagcgtcaggatagtacatgagtggtccgcaggctccgaggggcaggggctaggagtggctctcaatgtattacaccgtagtcggggtacggtcggggaaccacgtacgtaaccgtacggctaaggtacgttcccggttaggaacggggtccaaaggtaactttccgaaacccgtacttacccgtacccgaaaggtaacgtaaacctaaagttttgggaaaacgtaaccgaaccggtagtaaacttttaactaaagttactaacgaaaccgtaacgccgttaggaacgaacggtcccgtaaagtggaaaacccgtacgggtcctttaggttaccggttaatttttccggaggtttacggaccgggtaaagggtaacgggtaacggggtttaaaaccttaaaaggttacggtttaccgtttagggggtttacggaccccgtagggtttacccggggg

SEQ ID NO: 328388 - DNA, 603 bp, Homo sapiens
  misc_feature: GZ8MTXP02I7FFF.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaactagcagtgatggttggggttatcacttgtctcctggtaccaacaccaccccggcacgacgccccaaactcatgatttatgaggccactaagccgaccctcgacgggtctttctaatccgctttctctggctccaagtctggaccaaccaccggccctcccctgaccaatcctccgtgggcctccgaggctacggacgacggaggaccttaaattattactgacttgcctacattagtagtaaaggttaataaactacttaattacttacgttacgggacgggaacgggaccgaaagctacggacccgttccgtcggccgtacgaccggacccgaaacggtcctcccgcccccgtacggtccacttccgtccttccccacccgtcctccgctacgaacgacgtacggacggcggcgtacggacacggg

SEQ ID NO: 328389 - DNA, 556 bp, Homo sapiens
  misc_feature: GZ8MTXP02FMRMJ.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgacccccaaactcatgatttatgacggccactaagcgaccctcagggctttctaatcgctttctctcggctccaagtctggcaacaccggccctccctgacaatctcgtgggcctcaggctgaacgtcggaggacttaaattacttactgctgctactatatagtaaaggtttataaacactaatactagtacggcgggaggaacaagctacgaccgtctgccgtcgacgccgaaggcctcgcccccgtcggtacctactctccttccccaaccctcctccgccttaacgaacgtacgtcggacggcggcgacggacaagg

SEQ ID NO: 328390 - DNA, 653 bp, Homo sapiens
  misc_feature: GZ8MTXP02FM3CL.15.1.A01.1.454.CMB.2.raw
  modified_base (278)..(278): a, c, t, g, unknown or other
  misc_feature (278)..(278): n is a, c, g, or t
  modified_base (402)..(402): a, c, t, g, unknown or other
  misc_feature (402)..(402): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttgggggttatcaccttgtctcctggtaccaacacccaccccggcagacgcccccaaactcatgatttatgaggccactaagcgaccctnaggtctttactaatcgcttctctggcctccaagtctggcaaaccaccggcctccctagacaatctccgtgggcctccgaggctagacgacggaggacttaaatttaattacctggtctgcctanattatagtaaagttaataaacacttaataactagttacgggacgggtaagggaacccaaagtcgtacggacccgttccgtagacccgttacacggacccgaaacgggtccctccggtcccccccttacgggttccctaacccgttcctttcccggttaccccctaaccccgttccccgtaccgtacccgttaaaccggtaacgtaacccgttggaaccgggggtccggtcggtaccggacggaaaccgggg

SEQ ID NO: 328391 - DNA, 590 bp, Homo sapiens
  misc_feature: GZ8MTXP02FQMW2.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcacgacgcccccaaatcatgatttatgaggccactaagccgaccctcgaggtcctttctaactcgtctttctcgtcggtcctccaagtctcggaccaaccgacccggtccctacccctagaacctaaactcctacccgtcggggccctccgacggtcgtacggaacggcgaacggtactttaaattacttactgctgctcatatagtaagttataacactaatactagtcggacggtacggaccagcgtacgaccgtctgtcgtacgacgccgaacgcctccgccccgtcgtcctacctcctccgtccctaccgtccctacgccgtacgtaagtacgtacgtacggcggcgtcggacgacgg

SEQ ID NO: 328392 - DNA, 839 bp, Homo sapiens
  misc_feature: GZ8MTXP02JE9IL.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttgggggttatctacttgtctccgtcgtaccaaccacccacccgcacgaccgaccccaaactcatgtatttatggacggaccaactaacgccgaccctcgacggtctttactaatcgtctttctcgtgcctctaagtctcggaccaaccgaccggtcctaccctcgaaccaaacttcctacccggttcggggcctaccgacgggtccgtacggaacggacgggtacggttaactttaaactttacgtttacgtcgtccgttcgtaccctataaagtttacgtaaaggttaaacggtttaaacttaaaccttaaaccggttaaacttttaaccggttaacgggtttaccgggggaaccggggtaaacccgggggaaaccgtaaacggtacccggttaccggtaaccccggttcccggtacggtcccggtaccgtaacccggacccggtaacgggccccgtttcccccgggacccccgtttccccgggttaacccttaccccgtttccccgggtttaaccccccgtttcccccctaaaccccccgtttcccccggtaaaccccgggttccccgtttaaaccggggtaacgtacccgggttacgggacggggtaccccgggggtccggttacggggaaacccgtaaccggggg

SEQ ID NO: 328393 - DNA, 603 bp, Homo sapiens
  misc_feature: GZ8MTXP02JPERR.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaaccaccaccccggcagacgcccccaaactcatgatttatgaggccactaagcgaccctcagggtctttctaatcgtcttctctggctccaagtctggcaacaccggcctccctagacaactctccgtgggctccgaggctggacgacggaggtacttaattattactgctgctcatatagaagttaataacactatactagttcggacggaacgggacaacgcgttacgaccgtccgtgaccgttcgaacggcccgaacggtcctaccgtccccccgttccgggtaccctaccgttccgtttcccgtccccctaaccccgttccctcccgtaccgttaccggtaacggacgttacggacgggaccgggcggtacggacgaacggg

SEQ ID NO: 328394 - DNA, 627 bp, Homo sapiens
  misc_feature: GZ8MTXP02I9GHW.15.1.A01.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttcctgttgctattttaaaaggtgtccagtgtgaggtgcagctggtggagtcgtgggggaggcgttgggtccagggcccgggggggtccctggacgactctcatgtgcaggctctggattcgagcgtcaggatagtacatgagttcggccncgagctcgngggcaggggctagngtcgactctacaatgtacttacgacggtagtcggggacggtgggaccanactaacgtacgnaagtacgttccgagaacgggcaagtacttaccaactatccaccgaagaacgtaactaagtttagggaactaaaccgtacgtagtactttacttaaatatacgaaactacgtaccgagaagacggacccgtaagtacgaaccgtacggtcgttggttacgttagtttacgtggtaggcggaaaggtacggtaaggtaaattaacgtagtttaacgttgggtttacgaccgtaacggttcccggggg

SEQ ID NO: 328395 - DNA, 522 bp, Homo sapiens
  misc_feature: GZ8MTXP02FJWHT.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcacgacgcccccaaactcatgatttatgaggccactaaagccgaccctcaggctttctaatcgcttctctggctccagtctggcacacgcctccctgacatctcctgggctccaggctgacgacgaggctaattattactgctgctcatatagaagttaataacactatactgtacggcgaggacaagctgaccgtctgcgtcacgcccaagctcgcccccgtcggtccactcctcgttccccaccctccgtccgctacgtaacgactcgacggcggcgtacggcaaacggg

SEQ ID NO: 328396 - DNA, 737 bp, Homo sapiens
  misc_feature: GZ8MTXP02JHKKH.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctaccttgtcctccgtcggtaacccaaccacccgaccccggcacgaccgacccccaaactcatagtatttagtcggacgaccaacgtaacgccgaccctcgacggtcctttacgtaactccgtctttctcgttacggtcctaccgtaagtccgtaggaccaacccgtacccgggtccccttaccccgtagaacctaactcgtcccgtacgggtcctccgaggccgtacgaacggacggacgtacttaagttacttacgtgtcgtgtcctagtaagttaagttaaggtaaacgtttaacttaaacctaacgtttaaacgttaacgttacgggtttacggggacggtaaccggggaaccgtaacgtcgttaccggacccgttccgtacggtacccggtaccgacccggtacccggaacgtccccgtcccgtacccccggttccggtcctaccgtttccgttaccccttccccgtacccgttcccgtaccgtaccgtaacgtaacggtacgttcggacggcggtcggacggacgaaacgg

SEQ ID NO: 328397 - DNA, 634 bp, Homo sapiens
  misc_feature: GZ8MTXP02IFUNF.15.1.A01.1.454.CMB.2.raw
  modified_base (317)..(317): a, c, t, g, unknown or other
  misc_feature (317)..(317): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgccccaaactcatgatttatgaggccactaagcgaccctcaggcttctaatcgctttctctcggctccaagtctaggcaacncggcctccctgacaatctctcgggctccaggctcgacgcggacggtcttaaattacttactcgcttcgccttcattaataggtaaaggtttaacaaactaccgtaattaacttacgttacggggacgggaaaggtacccaaaggcctacgaccccgttcgttacgccgtcgaaccggcccgaaacggtcctacccggtcccccgtccggttcctacccgttccgtccgtttcccccggtcccccttcccgtacccgtacccgttaaccggtaacgaccgttacggcgggtccggggaccgtacgggaccgaacgggg

SEQ ID NO: 328398 - DNA, 514 bp, Homo sapiens
  misc_feature: GZ8MTXP02FHKY9.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttctctggctccaagtctggcaacacggcctccctgacatctcctgggctcaggctgacgcgaggctaaattattactgctgctcatatgaagttataacactatactattcggcggagggaccaagctgacccgtcctgccgtcacgcccaaggctcgccccctcggtcactctcgtcccgccctccgtcgctacgaagactgacgcggctcggcaacgg

SEQ ID NO: 328399 - DNA, 743 bp, Homo sapiens
  misc_feature: GZ8MTXP02FO3XE.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctcctgtaccaacaccacccgcagacgaccccaaatcatgatttatgaggccactaacgccgaccctcgaggtcttactaatccgtactttctcgtcggtctaccgtaacgtccgtgggaccaaacccgaacccgggtcccccttacccccgttacggaaacctaaacgtttccgtaccccgggttacggggtcccttacccgacggggtacctacggaacgggtacccggtaagggtaacctttaaaagttttacttaaccgtcggtacttcgtactaactaagttagttaaaggaaaagtttaaactaaaaccgtaactttaactaacgttacgttaccggggacggtaaacgggaaccaaaggtccgtacggtacccgttcgtacgtaccgtcgaaccgacccgaacgggccctaccggtcccccgttacggtacctaccgttcccttaccccgttacccccgacccttcccgtaccgtaccttaaccggtaacgtacgtacgggacggtcggtaccggtcggacgaaaccggg

SEQ ID NO: 328400 - DNA, 615 bp, Homo sapiens
  misc_feature: GZ8MTXP02JFYQE.15.1.A01.1.454.CMB.2.raw
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttgggtccgaggccgggggggtccctggagactctcatgtgcaggctctggattcagcgtcaggatagttacatgagttggccgccgaggctccgagggcgaggggctaggagtggctcgacaatgatttacacgtagtggggacggtggaccacgataccgtacgcaagtacttccggtagaacgggcaggacttccaccagttccaccgaagaacgaactaagtttagggaacgtaaacctaccgtagtaaactttacttaaaatatacgaaanacgtactagacgagccgtaancgacgtcgtgttcgtagttacgttcgtggtacgacggaacggtaggttaaacggtaagttaagttacggtttacggttacgggttaccgaccggtaacggtccgggg

SEQ ID NO: 328401 - DNA, 772 bp, Homo sapiens
  misc_feature: GZ8MTXP02H6F6D.15.1.A01.1.454.CMB.2.raw
  modified_base (231)..(231): a, c, t, g, unknown or other
  misc_feature (231)..(231): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccacccggnagacgccccaaactcatgattatgagccactaagccgaccctcgaggctttctaatcgtctttctctggctaccaagtctaggccaaacgaccggtcctccccgtagaacctaaattcctccgtggggcccttaccgaagggtcctacggaaccgtacgggaacgggtactttaaaacgtttactttaaccgtcgtccgttcgtacctacgtaaattaagttaggttaaaaagggtttaaactttaaaacctaaacctttaaagttaaccgtttaaacggtttccggggaaccgggggttaaaacggggacccgtaaaacggtccgttaacggtaaccccggtttcccgttagggacccggttacccgaacggtacccccgaaagggtcccgttaacccggccccccgttaccgggttcctaacccgtttcccggtttacccgttaccccccggttcccccgttacccttccccgttaaaaccggtcgtaaccgttacggaacggggtccggggacgttacgggaccggtaaacgggtccg

SEQ ID NO: 328402 - DNA, 657 bp, Homo sapiens
  misc_feature: GZ8MTXP02GJ4QJ.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttgggggttatcaccttgtctcctggtaccaacaccaccccggcagacgccccaaactcatgtattatgaggccactaagccgaccctcgaggtctttactaactccgtctttctcgtggtcctaccgaagtctcggacaaccgaccggccctccctagacaactcctccgtcgggcctccgaggtctgacggacgaggtacttaaagtttacttactgtcctgtcctactaatagttaggtaaaggtttaactaaactaacttaacttaaccgttaggttaccggggacgggaacggggaaaccaaacggtccgtacgaccccgttaccgtcggtccgtaccgacggaccccgaacgggtcccttcccggtcccccgttcggtacctacccgtttccctttcccccggcccttcccgtaccgtcctaacggtacaacggtcgacggcgggactcggacgtacggccg

SEQ ID NO: 328403 - DNA, 531 bp, Homo sapiens
  misc_feature: GZ8MTXP02HV5YI.15.1.A01.1.454.CMB.2.raw
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccacaccaccccggcagagcccccaaactcatgatttatgaggcactaagcgaccctcaggctttctaatcgcttctctggctccaagtctggcacacggcctccngacatctctgggctcaggctgacgcgaggctaattatttancgctgctcagtatgaaaggttntaaacncttaatacctagttcggcgggtaggacccgaagcttgaccgtccgtncgtcagcccgagcctcgccccctggtcctacgtcctcgttacccccaccttcccgtcgcgtaccgtaagcctggacggcgggtctcggcaacgg

SEQ ID NO: 328404 - DNA, 653 bp, Homo sapiens
  misc_feature: GZ8MTXP02GOCMT.15.1.A01.1.454.CMB.2.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagggcccgggggggtccctggagactctcatgtgcaggctcgtggattcagcgtcaggaatagttacatgagttcggtccgcgaggctccgagggcaggggctagngtggctcncaatgtattacgacggtagtcggggacgtggaccacgatacgtacgcagacttccggagaacgggcaagacttaccgactatcctaccgaagagtaactaagtttacggaacgtaacgtaccgtagtaatttacgttaaatacgttacgaaacacggtaccgttagacggacgaccgaagttacggaaccgtacggggtcctttaggttacgtttaagtttttccggaggttacgacgggaaggtaacgggtaaccggggttaaattaagtttaacggtttaacgttcgggtttacggacccgttaacgggttcccggggg

SEQ ID NO: 328405 - DNA, 599 bp, Homo sapiens
  misc_feature: GZ8MTXP02GF53G.15.1.A01.1.454.CMB.2.raw
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttatgaggccactaagcgaccctcgaggtctttctaatcgctttctctggctcaagtctggacaacgcgcctccngacaatctcgtcggctcgnggctagacgacgagtacttaattatactgctgctacatatagtaagttaataaacacttaatacgtagttacgggacggaacgggtaccaaaggtctacggacccgtcgtagaccgtcgaacggtacccgaaacggtcctacccggtcccccgttacggtacctaccgttccgttcccgttacccccaccccttcccgtaccggtaccttaccggtaacgtacgtcggacggccgggtacgtcgggacaacgggg

SEQ ID NO: 328406 - DNA, 849 bp, Homo sapiens
  misc_feature: GZ8MTXP02H52OG.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatctaccttgtctcctggtaccaaccaccgaccccgcagaccgaccccaaactcatgtattatgagccaactaacgccgaccctcgacggtctttacgtaatccgtctttcctcgtcggtctacccgtaagttcgtacgggacctaaaaccgcccgggtcccttacccgtacgtaacctaaacgtttcccgttcccggttacggggcccctttacccggacgggtacccgttaaggaacccgggtacggggtaaacgggttaaccttttaaaactttttaacgtttaacgttcggtcctttacggtccttactaagtttaagttaaggttaaaacggtttaaacttaaaccgttaactttaaacgtttaaccgtacggtttaccgggggacgggaaccgggtaaaccgtaacggtaccgttaccgggtaaccccgttccggtaccggtaccgttaccgaacccggttaccccgaaacgggtccccgttacccggtcccccccgtttaccgggtccctacccgtttccctttaccccggtttcccccctaacccccgtttccccgtaccggttaacccggttaaccggttaaccgaccggttaaacgggaccgggtccggggttaccccgtagggggaccccggaaacggg

SEQ ID NO: 328407 - DNA, 832 bp, Homo sapiens
  misc_feature: GZ8MTXP02IBIE2.15.1.A01.1.454.CMB.2.raw
  modified_base (254)..(254): a, c, t, g, unknown or other
  misc_feature (254)..(254): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggggttatcacttgtctcctgtaccaacaccacccgcacgacgaccccaaactcatgtattangacgacactaacgccgacctcgacggtctttactaatccgtctttctcgtggacctaccgtaaagtcgtcggacctaaacgaccggtccctaccctagaacctaaacgttcctccgtcggggtacccttccgacggtcgttacgggaaccgacggtaaacggttactttaaaacttttacgtttaaccgtcggtcctttacggaccctttaataaagtttaacggttaaacggttaaaaaggttttaaacttaaaaccgttaaactttaaaacgtttaaccgtttaacgggtttaccgggggaaacgggtaaaccggggaaaccgtaaaaccggtcggtttaaccggttaccccggttccggtacgttaccccggtaacgaacccggtaccccggaaaccgggttccccgttaccccggtaccccccggtttcgggttaaccctaaccccgttttccgttcccccggttttaccccccccgtaccccgtttaccccgtaccggtttaaccgtaaaccggttaaccggtaccggtacggggtaccgggtaccgggtaccggtaacgggaacggtaacgg

SEQ ID NO: 328408 - DNA, 655 bp, Homo sapiens
  misc_feature: GZ8MTXP02HQNY6.15.1.A01.1.454.CMB.2.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctctggtaaccaacaccaccccggnagacgacccccaaatcatgtattangagccactaagcgaccctnaggtcttactaactcgctttctcgttggccttacccgaaagtcgtacggaccaaacgaccggtccctcccgtagaacctaatccgtccggtcgggccctaccgaggttcacggaacggacgaagtaacttaaatttactactcgacttnacctanaaattagtaaaggtaaagttaaactaaacctaataacgttaacgtacgttacgggacgggaaacgggaaccaaaggtccgttacgacccgttgtccgacgacgaaccgacccgaaggccccgttcccgacccccgttcgtacctacgttccgtcccgttcccccgcccttcctaccggaccttaaacggaacgtaccgaggcgggacccggcggtacgaacgacg

SEQ ID NO: 328409 - DNA, 694 bp, Homo sapiens
  misc_feature: GZ8MTXP02GYCWW.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttgggtccagggccggggggtccctggagactctcatgtgcgaggctcgtggattcagcgtcaggaatagttacagtgaggttcggtccgccgaggcctccgaggggcgaggggctaggagtggctcgtcaatggtaatttacgaccggtagtcggggacggtgggaccacagtactacgcgtagtacttccggaggaacgggctaagtacttaccacctacgttccgaccgaaggacgtaaacgtaacgtttacggaaacgtaaaccgtaccggttagttaaactttacctttaaaagtacgttaacggaaacctacggtacctaaggaacggacggaccgtaagtacgaacgtacggtctttaggttacggtttactttcggtaggtacggtaacgggaaggtaacggtaacgggttaaattaaaggttaacggtttaaccggttgggtttaccggtacccgtaacggggtacccggggg

SEQ ID NO: 328410 - DNA, 675 bp, Homo sapiens
  misc_feature: GZ8MTXP02FFDTZ.15.1.A01.1.454.CMB.2.raw
  modified_base (527)..(527): a, c, t, g, unknown or other
  misc_feature (527)..(527): n is a, c, g, or t
  modified_base (573)..(573): a, c, t, g, unknown or other
  misc_feature (573)..(573): n is a, c, g, or t
  modified_base (604)..(604): a, c, t, g, unknown or other
  misc_feature (604)..(604): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctaattttaaaaggtgtccagtgtgaggtgcagcgtggtggaggtcgtgggggagtcgttgggtccgagggcccggggggtccctgagactcgtcagtgtgcgaggcttcgtggtatcgagcgtacgaaggtaatagttacagtggaggtttcgggacccgcgaggctaccgaggggcgaggggctaggaggtcggctcacgaagttacgtaacttacgaccgggtaaggtcccgggggtaacggggtacgggaacccacgtaacgtaaccgtacgaccaaggtacgtttaccggaggaaacgggcaaaggtacttaccgaacctattccgacagaacgtacaaagtttacggaaacgtaacaaccgttntaactttacgtaaatacgtagaactacggcctagagacgacggtanacggtaccgacgtgttgttagttactttcgnggttacgacggtaagaggttaaaggtaattaaagttacgttacggtgggttacgaccggtacgtacggggg

SEQ ID NO: 328411 - DNA, 582 bp, Homo sapiens
  misc_feature: GZ8MTXP02G9XG9.15.1.A01.1.454.CMB.2.raw
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttgganaacaccgtgattcttaaatatgaaacagcctgagagccgatgacacggctgtgtatttcngtgcgagaggacggtataatagttactggtttcgcctacgtcggggaccacggggaaccctggtactagtcgtcgtcgtcacggccctaccaccgacgggcccctacgtcccggttcccttcccccgtcggccctacccctccctacccaacgcgccacccgtcgcgggggccacgacggtccggcccgtgggcctcggaccgtggtaccgaaggtaccctacgtccgacgttacgacgtacgtcggacggcgggctacgggacaacggcgcgaacgtcgncncnn

SEQ ID NO: 328412 - DNA, 703 bp, Homo sapiens
  misc_feature: GZ8MTXP02HYUPI.15.1.A01.1.454.CMB.2.raw
  modified_base (467)..(467): a, c, t, g, unknown or other
  misc_feature (467)..(467): n is a, c, g, or t
  modified_base (590)..(590): a, c, t, g, unknown or other
  misc_feature (590)..(590): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttattttaaaaggtgtccagtgtgaggtgcagcgtggtggagtcggtgggggaggcttggtccgacgggcccgggggggtccctggagactctcatgtgcgaggtctcgtggtattcgaggcgtcgaaggtaatagttacagtggtaggttcggggtcccgccgaggcctccggaggggcgagggggctaaggaggtcggctctacgtaatgtaactttacgaaccggtaggtccgggggacggtacgggaccacgtagtacgacgcagtacgttccgtagggaagcaagacttccaaaccattaccncgaaagacgtaaactaagtttaggaacgtaaacgtaccgttagtactttaacttaaattagtaagaaacgacgtcctaggaacgtacggaccgagtaggaccgtacgcgtttaggtacgtttntttccgtggtacggtaccggtaagggtaacggttaaacggggttaaattaaaacggtttacggttttacgggtaacgggttttccggaacccggtttacgggtacccgggggg

SEQ ID NO: 328413 - DNA, 778 bp, Homo sapiens
  misc_feature: GZ8MTXP02HI90N.15.1.A01.1.454.CMB.2.raw
  modified_base (259)..(259): a, c, t, g, unknown or other
  misc_feature (259)..(259): n is a, c, g, or t
  modified_base (699)..(699): a, c, t, g, unknown or other
  misc_feature (699)..(699): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctcctggtaccaacacccacccgcacgacgaccccaaactcatgtatttagngacggccactaacgccgaccctcgacggtctttactaactcgtctttctcgtcggcctaccgaagtccgtacgaccaacccgacccggtcctcccgtaacgacctaacttcctcccgtcggggtcctaccgacggtacgtacggaaccgacgggtaacggtaacctttaaagtttaacttaccgtcggtaccttcggacctttacgtaaagtttaacgtaacgggttaaaaggttttaaacctaaaaccgttaaacctttaacgtttaaccgttaacgggtttaccgggggaaccgggtaaaccgggggtaaacccaaacggtccgttaaaccggtaccccggttccgttaaccggccgttaccgaccggtacccgaaccgggtccctaccccggtcccccgtacggtcctacccgttcccgttaccccgtttacccccncccgttaccgttccgaacccggttaacgtaacggtaccgtcgggtacggggccgggttaccggacgggaacgaaccggg

SEQ ID NO: 328414 - DNA, 723 bp, Homo sapiens
  misc_feature: GZ8MTXP02HA2D6.15.1.A01.1.454.CMB.2.raw
  modified_base (256)..(256): a, c, t, g, unknown or other
  misc_feature (256)..(256): n is a, c, g, or t
  modified_base (422)..(422): a, c, t, g, unknown or other
  misc_feature (422)..(422): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccacccggcacgacgaccccaaactcatgtattanggacgcactaacgccgaccctcgaggtctttcgtaatccgtctttctctcggcctaccaagtcctaggaccaaaccgccggtccctccctagacaaactcctcccgcggtcctaccgaggtctcgaacggcggtaacggtacttaaattacttacgttcgcgttanccgtataagtatagggtaaagttaactaaacacttaactaacgttacgttacgggacgggaaacggacccgtaaaggcccgttagggtaaccccctcggtccggaccgttcccgaacggttaccccgaacggggccctttccccggacccccggttcggttccctaacccgtttccctttccccggtttaccccccgacccctttaccccgttacccggtacccgttaaaccggttaacggtaaaccggttcggaaaccggggtccgggggttaccctacgggggtaaaccgaacccgggg

SEQ ID NO: 328415 - DNA, 679 bp, Homo sapiens
  misc_feature: GZ8MTXP02GZOJJ.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcacgacgacccccaaactcatgtatttatgaggccactaacgccgaccctcgagggtcctttactaactcgtctttctctggcctccgaagtctggaccaaccgaccggtccctcccctagaccaaacttcgtcccgtcgggcctacccgaggcgtaggacgacggaggtacttaaatttacttacgtcgtctcgtcctactaattagttaggtaaaggtttaactaaactacttaacttacgttaagttacggggacgggaaacgggacctaaagccgtacgacccgttccgtaggccgtacgaccgtcccgaaacggtccgtcccgtcccccgttccggtcctacccgtttccgttcccggtttcccccgtcccgttcccgtacccggtaccttaaccggaacgtaaccgtcggtacgggcccgggtacgtcggggaccgtaacggg

SEQ ID NO: 328416 - DNA, 657 bp, Homo sapiens
  misc_feature: GZ8MTXP02GRD9W.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctccgtaggtaaccaacaccgaccccggcacgacgacccccaaactcatgtatttagtgacggaccactacgccgaccctcgaggtctttacaatccgctttctctggcctacctaagtctaggaccaaaccgccggccctcccagaacacgttcaccgtcggctccgaggcgtagaccgagacgtacttaaagttactaacgttcgcttgcttacaattagtaaggtaaacgttaaactaaacacctttaagtaacgtacggttcgggaacgggtacgggaacctaagtcccgttacggtaccccgtccgttaagcccggttacgaccggtacccacgggtcctcccgtcccccgttacggtcttacccgttcttaccccggtccccaccccttccgtacggtaccttacgggaactccgaggacgtccgggctacgggaccctaagg

SEQ ID NO: 328417 - DNA, 599 bp, Homo sapiens
  misc_feature: GZ8MTXP02FSYZJ.15.1.A01.1.454.CMB.2.raw
  modified_base (453)..(453): a, c, t, g, unknown or other
  misc_feature (453)..(453): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggtatcacttgtctcctggtaccaacaccaccccggcagacgcccccaaactcatgatttatgagccactaagcgacctcaggtcttctaatcgcttctctggctcaagtctggacaacgacggcctccctgactaatctcgtcggctcgaggctagacgcggagtcttaaattattactgctgctcattatagtaaagttataaacactaatacgtagttacggcggtaagggaccaaagcgtacgaccgtcgtgccgtanacggcccgtaaaggcctccgtcccccgtcggtacctaccttccgttaccgttaccccctaacccgttcccgtaccgtaccgttaacccggtaacggtaccgttacggaaccgggccggggttcgtaccggggacgtaaacccgggg

SEQ ID NO: 328418 - DNA, 637 bp, Homo sapiens
  misc_feature: GZ8MTXP02HL6GR.15.1.A01.1.454.CMB.2.raw
  modified_base (481)..(481): a, c, t, g, unknown or other
  misc_feature (481)..(481): n is a, c, g, or t
  modified_base (541)..(541): a, c, t, g, unknown or other
  misc_feature (541)..(541): n is a, c, g, or t
  modified_base (592)..(592): a, c, t, g, unknown or other
  misc_feature (592)..(592): n is a, c, g, or t
  modified_base (626)..(626): a, c, t, g, unknown or other
  misc_feature (626)..(626): n is a, c, g, or t
tcagtctacgtagccacgaccggtgctcgatttagacgtctcatcaggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggagcttggtccaggccggggacggtccgtgagactctcagtgtcgcgaggtctcggtggtacttcgacgtcgtacgaaggtaatacgtactagtgttacggtcggtccgacgtacggccgtaccggacggcggacggggtacgtaaggtaacgggtcggtactacgtacgtaaagtcgtaacgtttaaccgaccggtaggtacggggacggtacggaacctatacttacgacgcgtaaagtacgttccgaagacggactagtacttaccgaacctntaccgcgaaagacgtaaccgttaagtacggaaactaccgtacgtatacttacgttaatanagacacgtcgagactacgcagtaccgacgagttcgtattgttagtcgtagngacgtagacgtaagttacagttacggtgtacggngtacgtacggg

SEQ ID NO: 328419 - DNA, 554 bp, Homo sapiens
  misc_feature: GZ8MTXP02FJOR9.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccaggcccgggggggtccctggagactctcatgtgcaggctctggattcagcgtcaggaatagttacatgagttgggtccgcaggctccaggggcaggggctagagtggctctcaatgatttacaccgagtggggacggtgggaccacatactacgcagattccggtagaagggcagacttacaccatctacagagacaatttggaagaacaccgtagattacttaaatatagaacagcctagagacgccgatcgacacgggctgttgttatttctgtcgacgagaggtacgggtaataaagttacgttacgtagggtttcgaccgtacgtaccggggg

SEQ ID NO: 328420 - DNA, 579 bp, Homo sapiens
  misc_feature: GZ8MTXP02IRKUM.15.1.A01.1.454.CMB.2.raw
  modified_base (410)..(410): a, c, t, g, unknown or other
  misc_feature (410)..(410): n is a, c, g, or t
  modified_base (527)..(527): a, c, t, g, unknown or other
  misc_feature (527)..(527): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctcctggtaccaacaccaccccgcagaccgaccccaaactcatgatttatgaggccactaagccgaccctcgacggtctttctaatccgtctttctcgtggcctccgaagtctggaccaaccgaccggcctccccgtagacctaatccgtcgtcgggcctccgaggctcggacgacggaggtactaattattactgtctgctnaatagtagtaagtttaataaactacttatactagtacgggacggaggaaccagtctagacccgtcgtcgcgtcacgcccaaggcctccgcccctcgtaccacttccgtcctaccccnccctccgtccgtactacgtaacacgtcggtacggcggtactcggacgaacgg

SEQ ID NO: 328421 - DNA, 426 bp, Homo sapiens
  misc_feature: GZ8MTXP02FP38Q.15.1.A01.1.454.CMB.2.raw
  modified_base (315)..(315): a, c, t, g, unknown or other
  misc_feature (315)..(315): n is a, c, g, or t
  modified_base (417)..(426): a, c, t, g, unknown or other
  misc_feature (417)..(426): n is a, c, g, or t
tcagtctacgtagccacgaccggtgctcgatttagacgtctcatcagggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttgcactggggccagggacccctggtcatcgtctcgtcagcctccaccaaggcccatcggtcttccccctgccnccctcctccaagacgcacctctcggggcacgacgccggccctgggctgcctggtcaggactactccgctacgtagactgagcgggctggcaaggcgcatagnnnnnnnnnn

SEQ ID NO: 328422 - DNA, 539 bp, Homo sapiens
  misc_feature: GZ8MTXP02GUYVR.15.1.A01.1.454.CMB.2.raw
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (481)..(481): a, c, t, g, unknown or other
  misc_feature (481)..(481): n is a, c, g, or t
tcagtctacgtagccacgaccggtgctcgatttagacgtctcatcagggcctgggctctgctgctcctcactctcctcactcaggacacagggtcctgggcccagtctgtcctgactcagcctgcctccgtgtctgggtctcctggacagtcgatcaccatctcctgcactggaaccagcagtgatgttgggggttatcaccttgtctcctggtaccaacaccaccccggcagacgccccaaactcatgatttatgaggccactaagcgaccctcagggtctttctaatcgctttctctcggctccaagtctggcaacacggcctcccngactaatctccgngggcctccaggctgacgacgagcttaaattatactgctgctcatatagtaaacggttataaacactacttactagttcgggacggaggaccaaagctgtacccgtctgccgtcacgccgaagctccgacccctcgtacncctcgtccttccccacctcctcgcttaacgcgtacgtcgacgcggcgtcggacaacgg

SEQ ID NO: 328423 - DNA, 689 bp, Homo sapiens
  misc_feature: GZ8MTXP02G90FL.15.1.A01.1.454.CMB.2.raw
  modified_base (271)..(271): a, c, t, g, unknown or other
  misc_feature (271)..(271): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatcctcctgcactggaaccagcagtgagttggttggggttatctaccttgtctccgtacggtaaccaaccacccgacccggcacgaccgaccccaaatcattagtatttagngacgaccaacgtaacgccgaccctgacggtcttactaactccgtctttctacgtcggcctacaagtcgtacgaccaaccgccggtccctaccagtacctaacgttccgtcgtcggcctccgacggtctacggacgaggtaacgtacttaaatttctacgtcgctcgacttagtaattacgtaggttaaaagttaataaactacttaacgtacgttacgggtccgggacgggaaaccgggtaaactaacggtccgtaaacgtcccgtcgtcgacgtacccgaccgaccgaacggtccctacccgtcccgttacggtacctcccgtttccttaccccgtacccctaccccgttccgtaccgtaccgttaccggtaacggtcgaacggtaccggggcgtaccggacgggaacgtaacccgg

SEQ ID NO: 328424 - DNA, 564 bp, Homo sapiens
  misc_feature: GZ8MTXP02I8S4Q.15.1.A01.1.454.CMB.2.raw
  modified_base (296)..(296): a, c, t, g, unknown or other
  misc_feature (296)..(296): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaaatatgaacagcctgagagccgatcgacacggctgtgtatttcngtgcgagagacgggtataatagttactggtttgcctacgtcggggcccagggaaccctggtcacgttcgtctcgtcacgccctccaccgaacgggcccacgtccggtcccttcccccgtcggcccaccccgtccctaccccgaagacgccaccctcgtcgggggaccacgacgccggcccgtcgggcctcgccgtggtccaacgggacctaccgtccgctacgtacgactcggacggcgggcgtcggcgaaggcgcgacgtagncnnn

SEQ ID NO: 328425 - DNA, 704 bp, Homo sapiens
  misc_feature: GZ8MTXP02IP2OS.15.1.A01.1.454.CMB.2.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaccaacaccacccggnagacgaccccaatcatgtattangacggaccactaaacgccgaccctcgacgggtctttacgtaatcgtcttctacgtcggcctccaagtcgtggaccaaccgcggccctaccctagacctaatccgtaccgttcgggcccttccgaggtcgtacggaaccgacgggtaggtactttaaaattacttaacctggtccttagacctactaagttagtagtaaaggtttaaactaaacctattaacttaacgtacggttccgggaacggggtacgggtaaccgaaagtccgttaacggacccgttacgtaccggcttaccggtaccgaccccggtaacggccccttccggtaccccccgttacgggtaccctacccgttccggttaccccttacccccgacccctttccgtacccgtacctaaccggtaaacgtcgttaacggccgggtacgggtcccgttacgggaccgaaccggg

SEQ ID NO: 328426 - DNA, 759 bp, Homo sapiens
  misc_feature: GZ8MTXP02F8M3T.15.1.A01.1.454.CMB.2.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcctaccttgtcctccgtacggtaacccaaccacccgaccccggcaacgaccgacccccaaactcatgtattangagaccagacgcgaccncgaggtcttatagtcgtctttcncgtcgctacgaagtcgtcgacaaccgaccgtccctacctagacctaatccgtccgtcgggtctaccgaggtcgtacggacggacgtaacggtactttaaacgttcttaccgtgtactgtacttactaagtagttaaaggtaacgttaaactaaactaacttaagttaaccgtagggttaccggggaacgggggaacggtaacccgtaagtacccggttacggtaaccccgttaccggtccgtaccccggtaccgaccggtaaccccggtaaccgggtcctttaccccgggcccccgttcgggttaacccttcccggtttaccccgggtccctttccccccgggtacccctttcccggtaaaccccggttacgtttaaaccccggtaacgtacccggggttacggacccgggggtcccggggtacggtacggggaaccggtaaccggg

SEQ ID NO: 328427 - DNA, 692 bp, Homo sapiens
  misc_feature: GZ8MTXP02JHQIJ.15.1.A01.1.454.CMB.2.raw
  modified_base (304)..(304): a, c, t, g, unknown or other
  misc_feature (304)..(304): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgcttatttaaaaggtgtccagtgtgaggtgcagctggtggagtcgtgggggaggcttggtccgagggcccggggggtccctggagactctcagtgtgcgaggctcgtggattcagcgtcaaggaatagttacatggagttcgggtccnccgaggcctccgaggggccgaggggctaaggagtggcctctacgaatgactttaccgacggtaggtcggggaccggtgggacccagtactacgtacgcgaagtacgttcccggtaggaaacggggcaaagtacttacccacgaactcctaaccgagaacgaactaagtttacgggaaacgtaacgtaccggtaagttattaccgttaaatacgtagaaccgtagccgtaggaacgacggaccgtagacggaaccgtcggtccgttagggtagtttaacttttccggagggtacggacggtaagggtaaacgggttaaacggttaaagtttaaacggttacgggtttaacggttacggggttaccggacccggttaacggggtacgggg

SEQ ID NO: 328428 - DNA, 568 bp, Homo sapiens
  misc_feature: GZ8MTXP02ID2NX.15.1.A01.1.454.CMB.2.raw
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (558)..(558): a, c, t, g, unknown or other
  misc_feature (558)..(558): n is a, c, g, or t
  modified_base (564)..(568): a, c, t, g, unknown or other
  misc_feature (564)..(568): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagagttccgtgaagggcagattcaccatctccagagacatttggagaacaccgtgtattcttaatatgaacngcctgagagccgatgacacggtctgtntatttcngtgcgagagtacggtataatgttactggttgccagtcgggccagggacctggtctacgtcgtcgtcgtcncgtcctccgaccgaagggcccacgtcggtcccttccccgtcgcccncccttcccaccaagtacgcctaccgtcgtcgggggccaaccgcggccggcccgtcgggcctcgtaccgtggtaccgaaacgggtacctacccgtttccgactaacggttacgacgttaggaccggcgggctcgggccaaggccgntagacnnnnn

SEQ ID NO: 328429 - DNA, 672 bp, Homo sapiens
  misc_feature: GZ8MTXP02GPD1K.15.1.A01.1.454.CMB.2.raw
  modified_base (261)..(261): a, c, t, g, unknown or other
  misc_feature (261)..(261): n is a, c, g, or t
  modified_base (621)..(621): a, c, t, g, unknown or other
  misc_feature (621)..(621): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctacttgtctcgtcggtaccaaccaccacccggcacgaccgaccccaactcatgtatttagngacggaccaacgtaacgccgacccgtacgacggtcctttcgtaactccgtctttctcgtcggcctaccaagtctcggaccaaccgaccggccctacccgtagaaccaacttcctaccgtcgggtcctcgacggctacggaaccgacgggtaacgtactttaaagtttaacttacgtcgtaccttgtacctataattagtaaggtaaagtttaaactaaactacttaagttaacgttaggtccgggaacgggtaacggggaacctaaggtcgtagacgttccgtccgtacgcgtaccgaaccgacccgaacgtcccgtacccggtcccccgtacggtcccacgttcccgttccgttccccncccgttcctcgtacgtaacgtacgacgtacggacggccggacgtcggacgg

SEQ ID NO: 328430 - DNA, 639 bp, Homo sapiens
  misc_feature: GZ8MTXP02H4L7W.15.1.A01.1.454.CMB.2.raw
  modified_base (178)..(178): a, c, t, g, unknown or other
  misc_feature (178)..(178): n is a, c, g, or t
  modified_base (260)..(260): a, c, t, g, unknown or other
  misc_feature (260)..(260): n is a, c, g, or t
  modified_base (447)..(447): a, c, t, g, unknown or other
  misc_feature (447)..(447): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggggttatcaccttgtctcctggtaccaaccaccaccccggcacgacgaccccaaactcatgtattttangacgccactaagccgaccctcgacgggtctttactaactcgtcctttctcgtcggcctaccgaagttctacgggaccaaaccgaccggtcccctacccgtcgaaacctaacgttcctccggttcggggacccttccgaggtcctacggaacgacgaggtacttaaatttacgttactgcttgcctanagtatacgtaagtttaaacaactacttaattacgtagttccggacggaacgggaccaaagtcgtcggtacccgtctcgccgttcgacgcccgacggcctcccgccccgtcgtccacgttccgtccgtttccccgacccttccgtccgtaacgttcgtaacgccgtaagccgggcgtcggtacggacaacggg

SEQ ID NO: 328431 - DNA, 579 bp, Homo sapiens
  misc_feature: GZ8MTXP02IL8OJ.15.1.A01.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (380)..(380): a, c, t, g, unknown or other
  misc_feature (380)..(380): n is a, c, g, or t
  modified_base (486)..(486): a, c, t, g, unknown or other
  misc_feature (486)..(486): n is a, c, g, or t
  modified_base (532)..(532): a, c, t, g, unknown or other
  misc_feature (532)..(532): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaaagccgacctcagggtctttctaatcgctttcnctggctccaagtctggccaacncggcctcctgacaatctcgtggcctccaggctgacgacggagtactaaattattaccngcttagctcattatagtaaaggtttaataaactacttaattacttaacgttacggggcgggtaaaggggacccaaaggtctacgtacccggttccttggcccgtanacgccccgaaaggcctcgcccctcggtccacgtcctcgttaccccnccctcctaccgctaacgtgacctggacgtcgggacgtcgacgaacgg

SEQ ID NO: 328432 - DNA, 708 bp, Homo sapiens
  misc_feature: GZ8MTXP02IWBFM.15.1.A01.1.454.CMB.2.raw
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttcctgttgcttaattttaaaaggtgtccagtgtgaggtgcagctgggtggagtcgtggggggaggtcttggtccgagggcccgggggggtccctggacgtactctcgattggtgcgaggccttcgtggattcgagcgtcgaggaatagttacagtgtaggttcgggtcccgtccgacggcctaccgaggggcgaggggcgtaggaggtggccttcgtactaagtgtaacttttaccgaacggtaggtcggggaccgggtcggggacctacgactaaccgtacgcctagtaacgtttcccggtaagaacggggtcaaacgggtacttaccaacccgtataccctaccgaaggtaacgtaacctaaaggtttaggaaaccgtaaacgtacccgtagtaaactttaacttaaaactaagttaacgaaactacggtacccaggtaacggacgacgagttaacgacgtacgctagttgtttagtttactaggttcgcggtaaggacgtaggttaacgttaaggttacgtttacgttggtttacggtccggtacggtaccggggg

SEQ ID NO: 328433 - DNA, 645 bp, Homo sapiens
  misc_feature: GZ8MTXP02J1UOM.15.1.A01.1.454.CMB.2.raw
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttgggggttatcaccttgtctcctcggtaaccaaccacccaccccggcacgacgaccccaaactcatnattatgagccactaagccgacctcgaggtcttactaatcgtctttctcgtggcctcagtcgtgacaacnccggcctcctgacactctccgtcggctcgacggtcacgacggcgaggtacttaaattattacgtcgctgactactaattagtagtaaagttaataactacttaataacgtagttccgggacgggtaaacggaccaaagtcgtcgaacccgtccgtacgtccgcgaaccgtacccggtaacggcccgttccccggacccccgttaccggtcctaccttccgtacccccggttcccctaacccccttccgtacccggtaccttaaacggggtaaccttaacggcgggaccgggacgggtaccgacgggggacaaaccgggg

SEQ ID NO: 328434 - DNA, 640 bp, Homo sapiens
  misc_feature: GZ8MTXP02JWUGK.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcgtacttgtcctcctcggtaaccaaccacccgaccccggcacgaccgaccccaaactcatgtatttagcggagaccacgtaacgccaccgtacgacgggtctttacgtaactccgtcgttctcgtcggtcctacgtaagtcgtacggaccaaccgaccgtccctcccgtagacctaacttcgtccgtcgggcctccgacggtcgtacggacgacggtacggtacttaagttacttacgtgtactcgactatatagtaaggtaaacgttaacaaactactataacgtgtacggacgggtaacggactaaagcgtacgtaccgtcgtgccgtacgaccgaccgacgtccgtacccgtcccgtcgtaccgtccttcccgttccgtccccgtcccttaccggctacgtacggtcgtacgaggtccggcggaccgtcggacgacgg

SEQ ID NO: 328435 - DNA, 686 bp, Homo sapiens
  misc_feature: GZ8MTXP02IGTN7.15.1.A01.1.454.CMB.2.raw
  modified_base (495)..(495): a, c, t, g, unknown or other
  misc_feature (495)..(495): n is a, c, g, or t
  modified_base (605)..(605): a, c, t, g, unknown or other
  misc_feature (605)..(605): n is a, c, g, or t
  modified_base (624)..(624): a, c, t, g, unknown or other
  misc_feature (624)..(624): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctcctacggtaccaaccacccacccgcagaccgaccccaaactcatgtatttagtaggacggtaccaacgtaacgcccgaaccctcgagggttacctttactaacgtccgtctttcgtcgtcggtcctaccgtaacgtcgtcggacctaacccgaccggtcccctacccgtagaactaacgtctccccggtcggggtccaccggacgcgtacggacgtacggtacggttaacttaaactttaacgttctcggactcgtacctagtactagtaagtaacggtttaaanaaactacttatacgttacggtcgggaacgggaaacggccgaagtcccgtacgtacccgttcgacgttccgacgaccggacccgacggtccgtcccgtccccgtacgtccnccgttctcccgttaccccncccgttcgaccgtcgtaacgtcgtacggtacggacgggtcccggaggtacggaacgtccggg

SEQ ID NO: 328436 - DNA, 725 bp, Homo sapiens
  misc_feature: GZ8MTXP02FURIC.15.1.A01.1.454.CMB.2.raw
  modified_base (634)..(634): a, c, t, g, unknown or other
  misc_feature (634)..(634): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttggtccgagggccgggggggtccctggagactctcatgtgcaggctcgtggtattcgagtcgtacgaaggtaatagttacagtggtaggtttcgggtccgccgacggccgtaccggaggggcggacggggacgtaggaggtcgggccttcgtactaagttacgtaacgtttaaccgaaccggtaggtaccggggggtaccggggtacgggaaccaacgtacgtaaccgtacgacgtacgtacgttaccggtaggaacgggacgtaacgtacttaccgacctacttcctaaccgaaggaaacgtaactaagtttaggaaaacgtaacctaccgtagttaactttaaacttaaattagtaacgtaaacgacggtacctacggaagacggaccgaagtcggaaccgtacgggtcttacgggttntttacgtttcgtaggtaggtacggaaaggtacggtaaacgggtaatttaacgtaggtttaccgttgggtttacggccgttacggtacgggg

SEQ ID NO: 328437 - DNA, 747 bp, Homo sapiens
  misc_feature: GZ8MTXP02HNNK3.15.1.A01.1.454.CMB.2.raw
  modified_base (382)..(382): a, c, t, g, unknown or other
  misc_feature (382)..(382): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggtttttccttgttgcttaattttaaaaggtgtccagtgtgaggtgcagctggtggagtcggtgggggagtcgttgggtcccgaggggcccggggggggttccctggacgtacctctacagttggtgccgaggtctcgtggtacttcgaggtccgtagaaggtaattagttaacagttggtacggttcgggtccccgaccgtacggtcccgtaccggaggggcggaggggcgtaaggnggtcggccttctacaagttcgtaattaccgaccggtaggccgggggtacgtacgggaccaagtactaccgtagcgtaagtacgttaccggtaggaacggcaagtaccttaccacctacgtacccacgaaggtaactaacgttaaagtttcggaaacgtaacgtaccggttattaaactttaacttaaagtaacttacggaaaactcgggtcaaggaccgaggaaccgtagacgtaccgtacggtctttaggggttactttagtttcggtagggtacgaacgggtaacggtaacgggttaaagttaacgtttaaggtttacgggtttacggttacgggtaccggtaaccggttacgggggtaccgg

SEQ ID NO: 328438 - DNA, 625 bp, Homo sapiens
  misc_feature: GZ8MTXP02HLAX1.15.1.A01.1.454.CMB.2.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtggaccanatactacgcagattccgngaagggcagattcaccatctcagagacaattgganaacnccgtnattcttaanatgaacagcctagagacgccgatgacncggcttgtnttatttcngtgcgaaggaaggtacggggttaataaacgttagtttacgttggggtttacgcccgtaggtcccgggggacccgaacggggtacccctgggttacacgttccggttccgtccgtacaccgtccctacccgaaccgaaacgggccccacgttccggtccccttcccccgtcggcccacccctccctaccaacgacgaccacccgtcggacgggggaccaccgacggcccggcccggtcgggtccgtcgcccgttcggacgaacggtaccttaccgtccgacgttacgtacgagtcggacggcggcgcggacgacggcgcagtacgncncnn

SEQ ID NO: 328439 - DNA, 900 bp, Homo sapiens
  misc_feature: GZ8MTXP02I7O2G.15.1.A01.1.454.CMB.2.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatctacttgtctcctggtaccaacaccaccccggnacgaccgaccccaatcatgtattangagacactaacgcacctcgnggtcttctaatccgtcttctcgtcggcctaccgaacgtccgtaggaccgaaacccgtacccgggccccttccccgtagtaacctaaacgttctccccggtcggggtacccttacccgaacggggtcctaacgggtaaacccggacgggtaaacggttacctttaaaatttaaccgtttaccgttcgaccgttcggtacccttaagtaaacttttaaacgtaaaggggtttaaaaccgggttttaaaaacttaaacccttaaaaccgtttaaaccgtttaaacccgggttttaaaccgggtttaccccgggggtaaaccgggggtaaaaccggggaacccccggttaaaagtcccgggtttaaaccccgggtaccccccgtttccgggtaacccggggttacctacccggtaaaccccggacccggtaaaacccgggtccgttaacccccggtcccccccgggttccgggtaccccttaacccgggttcccctttcccccggggtttacccccccgtaccccctttacccgtttcccgggacctttaaacccggggaacggttaccgtaacgggggtacccggtccgggggacccggtttaccggggaaacgggtaacccggg

SEQ ID NO: 328440 - DNA, 642 bp, Homo sapiens
  misc_feature: GZ8MTXP02G8MN4.15.1.A01.1.454.CMB.2.raw
  modified_base (591)..(591): a, c, t, g, unknown or other
  misc_feature (591)..(591): n is a, c, g, or t
  modified_base (631)..(631): a, c, t, g, unknown or other
  misc_feature (631)..(631): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtcctccgtcggtaaccaaccacccgaccccggacacgaccgaccccaaactcatgtattagtggacggaccaactacgccgaccctcgaggtcctttactaatccgtctttctcgtcggtcctaccgtaaggtccgtacggacaaaacccgcccggtccctccccgtagtactaactcgtccgtacggcctcgacgcgtagacgcgtacgtactaatttactactgtctgacctataagttatagggtaaattataaaacctcttaatacgttaggtaccgggaggtaacggaccagtaccgtcgtacccctcggtcgcccgacgaccgaccgtacggtcccgtacccgcccccgtacggtctacccgtcgtcccggttacccncccttcgacctcgttacgaacgtcgtcggacggccggtcncggacgaacgg

SEQ ID NO: 328441 - DNA, 740 bp, Homo sapiens
  misc_feature: GZ8MTXP02GRFBT.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctggtctcctggacagtcgatcaccatcctcctgcactggaaccagcagtgtagttggtttaggggttactcgtaccttcgttccttccgtacggtaacccaaccaaccccgaccccggacaacgaacccgaccccctaaactacacttagaattttagtacggacggaccctaacgtaaacgaccgtaccccgtacggacggttctttacctaacgtccgtcctttcctcgtcgtaccgtaccgtaacggtccgtacggaaccgaacccgtaacccggtcccttcccccgtagaaacctaaacgttcctccggtccggtccgtaccgaacggtccgtacggacggtacggtaacgtacttaaagtttacgtaacgtgtacctcgtacttaactattaagtaacggttaaaagttaaactaaactaacttagtaacttacggttacgggaacgggtaacgaccgaacgtcgtacgtacccgtcgtacgccgtacgccgaccgtaagcccgtccgccccgtagtccctacgtccttacccgttacccctaccgtccgtacgccgttaacggtcgacggtaggtccggacgggtcacggacgaacccgg

SEQ ID NO: 328442 - DNA, 685 bp, Homo sapiens
  misc_feature: GZ8MTXP02FHXHH.15.1.A01.1.454.CMB.2.raw
  modified_base (558)..(558): a, c, t, g, unknown or other
  misc_feature (558)..(558): n is a, c, g, or t
tcagtctacgtagccacgaccggtgctcgatttagacgtctcatcaggggggggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggagtcgttggtccgagggcccggggggtcctggagactctcatgtgcaggctcgtggatcgagcgtacgaaggtaatagtacagtggtaggttcgggtcccgcgaggcctccggaggggcgaggggctaggaggtcggctctacaagtgtaattaccgaccggtaggtacgggggaccgggtacggggaaccacgtaactaccgtacgctaaggtacgtttccggaggaaacgggcaaggtacttaccgaacctattccaccgaagaacgaactaaagttcggaaacgaacctacgtataactttacgtaaatcgtaagaactacggcctaggaacggacgtaccggtaanacggaaccgtacgggtcttaggttagtttactttcggtaaggtcggacgtaaggacggggtaacggttaaaattaaaggtttacggttacggtttgggtttaccggacccgtaacggggtccggggg

SEQ ID NO: 328443 - DNA, 471 bp, Homo sapiens
  misc_feature: GZ8MTXP02F5QJU.15.1.A01.1.454.CMB.2.raw
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (464)..(471): a, c, t, g, unknown or other
  misc_feature (464)..(471): n is a, c, g, or t
tcagtctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggttgccagtggggcaggaccctggtcatcgtctcgtcacgccctaccgaccgaacgggtccccagttccggtccctttccccccgtacggccctaccccctccctaccgaacgacgacccaccgttcggtcgggggaccacgacggccccggtccccgtgggctcgccgtaggtcacggtactaccgttccgactacgtagactgacgcggcnggacaggcntagnnnnnnnn

SEQ ID NO: 328444 - DNA, 768 bp, Homo sapiens
  misc_feature: GZ8MTXP02JOA61.15.1.A01.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcaccttgtctccgtggtaccaacaccaccccggcacgacgaccccaaatcatnatttangaggccactaagccacctcgaggtctttacgaatcgtctttcncgttcggctaccgagtcgtcggacaaccgccggtccctcccgtacgacctaacgtccgtcccgtcgggtcctaccgacggtccgtaacggaaccgtaccggggtacgttaacgtttaaaacttttacgttaaaccgttggtacctttcggtacctttaacctaagtttaagtaaagggtttaaacggtttaaaacttaaaacctaaacctttaaacggttaaacctttacgggttaccgggggacccggggttaaaacgggggaaacccccttaaagtaccccggttcccgtaacccggttcccggtaccgtaccggttacccgaacccggttacccggaaacgtccccgttaccccggtccccccgttacgggtacccttaccgttccgtttaccccgtcccgttcccgtcccgttaacgtacctaacggtcgaacgtcggaccgggcggtccggtagccggaacg

SEQ ID NO: 328445 - DNA, 588 bp, Homo sapiens
  misc_feature: GZ8MTXP02FGFHX.15.1.A01.1.454.CMB.2.raw
  modified_base (405)..(405): a, c, t, g, unknown or other
  misc_feature (405)..(405): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaaccacccacccggcagacgcccccaaactcatgatttatgaggccactaagccgaccctcgaggtctttactaatcgctttctctggcctccaagtcgtggacaacgaccggccctccctgaacaactctccgtcgggcctcgacggctacggacgacggacggacttaaatttactactgctgctnatagtagtaagttataacactatactagttacgggcggaagggaccaaggctacggacccgttcgtagccgtacgacgacccgaacggcctcccgtacccccgtcggtacctaccttccggttcctaccccctccctcccgtcgcgttaacgcgactggaccggtcggcgtacggacgaacgg

SEQ ID NO: 328446 - DNA, 713 bp, Homo sapiens
  misc_feature: GZ8MTXP02JCC17.15.1.A01.1.454.CMB.2.raw
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagtcgttgggttttccttgttgcttaagttttaaaaggtgtccagtgtgaggtgcagctggtggagtcggtgggggaggtcgttgggtccgaggggtcccggggggtccctggacgactcgtcagtgtcgcaggtctcgtggtacttcgagtcgtacaaggaatagttacatggtaggttcggccnccgaggtctccggagggcgaggggctaaggaggtcgctatactaatgtaacgttacgacggtaggtaggggaccgtacggaaccagtaattaccgacncgagtacgttaccggaggaacggtacagtcttaccgacctagtactaccgagaacgtaaacttaaacgttaagggaaccgtaaaccgtaccgttaagttaaaactttacctttaaaagtaacgtaacggtaaacaccggtacccgtaaggaacgtcggaccgaagtacggaaccgtacggtctttaggtctttacggttcgttaggtacggtacgtaacggaaggtttaaacggttaagttaaaggttacggttacgtttcggttaccggtacggtacggggtacccgggg

SEQ ID NO: 328447 - DNA, 638 bp, Homo sapiens
  misc_feature: GZ8MTXP02FIQ5G.15.1.A01.1.454.CMB.2.raw
  modified_base (397)..(397): a, c, t, g, unknown or other
  misc_feature (397)..(397): n is a, c, g, or t
  modified_base (570)..(570): a, c, t, g, unknown or other
  misc_feature (570)..(570): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaaccaaccacccaccccggcacgaccgacccccaaactcatagatttatgacggaccacgtaacgccgaccctcgaaggtcctttacgtaactcgtcctttctcgtcggtcctccaacgtcgtcggacaaacccgaccggtccctccccgtagacctaacgtcctccggtcgggtcctaccgnggtcacggaacggacgtaacggtacttaaatttacttactgtctatcctacgtaattacgtagtaaaggtttaactaaacctaacttaaacttacgtacggtaccggggacgggaacggaaccaagcttcgacccttcgcgctcacgacccgaggccctccgccccgtcgacnccgtcttcccgtaccctacccctcgttccgcttaacgaacgacgtcggacggccggagtccgagaacg

SEQ ID NO: 328448 - DNA, 665 bp, Homo sapiens
  misc_feature: GZ8MTXP02FLXSD.15.1.A01.1.454.CMB.2.raw
  modified_base (261)..(261): a, c, t, g, unknown or other
  misc_feature (261)..(261): n is a, c, g, or t
  modified_base (529)..(529): a, c, t, g, unknown or other
  misc_feature (529)..(529): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatctaccttgtctcctggtaaccaacaccaacccggcacgaccaccccaactcatgatttanggacggaccactaacgccgaccctcgacggtcttactaatcgtctttctcgtcgcctaccgtaagtctcggacaaccgacccggccccttccctagaacctaacgttccgtccgtcgggacctcgacggcctaggaacggacggacgggtacttaaatttacttaacgtgtctacgtaccttataagtaagttaacggtaaaggtttaactaaacaacttattaacgtgttacgggacgggaacggaaccaagcctacgaccccgttntacgccgtacaccgtacccgagtcccgtcccgtccccgttcgcttaccccttcgttccccgttacccctacccctccgttaccgactttacgggaacgtacggtcggaaccggcggggtctacggaccgtaacggg

SEQ ID NO: 328449 - DNA, 867 bp, Homo sapiens
  misc_feature: GZ8MTXP02H27Z3.15.1.A01.1.454.CMB.2.raw
  modified_base (232)..(232): a, c, t, g, unknown or other
  misc_feature (232)..(232): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggttatcacttgtctcgtggtaaccaacacccgacccggnaacgaccgaccccaaatcatgtaatttagcgacgaccaacgtaacgccgtaccctagaggtctttactaacgtccttcttcctacgttcggaccttaccgaaaggttccgtacgggaaccaaacccgtaaccggtccccttccccgtaaaagtaaacctaacgttccgtacccggtaccgggtacccgtccgggtaacggtaccgtaacggaaaccggtacggtaaacgtttaaactttaaacgtttacgttaccgttacgtacgttacgtaacgtaacgtaaacgttaaacgttaaacggttaaaacggttaaacgttaaaacttaaacgttaaacgtttaaacggttaacgggttaccggggtaaccggggtaaaccgggtaaaccggtaaaccggtaccggtaaccggtacccggttaccggtaccggtaccggtaccggtaacccggtaacccggtaacccggtaccccggtaccccggtacccccggttacccggttacccgttacccgttacccgttaccccgttacccccgttacccccgttaccccgttacccgtaacccgttaaccggttaacggtaacggtaacgggtaccgggtaccgggtaccggtaccggtaacggtaacgg

SEQ ID NO: 328450 - DNA, 502 bp, Homo sapiens
  misc_feature: GZ8MTXP02IDVOT.15.1.A01.1.454.CMB.2.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (480)..(480): a, c, t, g, unknown or other
  misc_feature (480)..(480): n is a, c, g, or t
  modified_base (482)..(502): a, c, t, g, unknown or other
  misc_feature (482)..(502): n is a, c, g, or t
tcagtctacgtagccacgaccggtgctcgatttagacgtctcatcaaggggaaggggctgggagtgggtctcaactatcagtggtagtggtgttagcacatattacgcagactccgtgaagggccggttcaccatctccagagacaattccaagaacacgctgtatgttcaaatgaaacagcctgagagccgaggacacggccgtatatactgtgcgaaanaccttgtgtatagcagtgcctaggtaccaaggtnactacgtgggccagggaaccctggtcaccgtctcctcacgcctacccaccaacgggcccacgtccggtcctttcccccctggcccacccctccctccaacgacgcaccgtcgtcggggcacacgtccggcccgtgggcctgaccgtcggtcgaacggtacttaccgttccgtccgtacgtacgactgacgggcggggctacgggacgaaacggggccatagaagngnnnnnnnnnnnnnnnnnnnnn

SEQ ID NO: 328451 - DNA, 591 bp, Homo sapiens
  misc_feature: GZ8MTXP02F6X7J.15.1.A01.1.454.CMB.2.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctgaccacaccacccgcagacgaccccaaatcatgtattatgacgccacgtaagccgaccctcgaggtctttactaatcgtctttctcgtcggctcaagtctgacaacnccgcctccnacatctcgtgcctcgagctaggacgcggagtacttaaattacttactgtactgtactacaattagtaaggtaaagttaactaaactacgttaactacgttacgtacggggacggaaacgggtacccaaagtccgtacgtacccgtcgttcgaccgtacgaccgaccgaacggtcccgtaccgtccccgttacggtcctccgttccgttcccgtccccgcctaccgtcgtactacgtaagctacggacgcggctacggaacgacgg

SEQ ID NO: 328452 - DNA, 568 bp, Homo sapiens
  misc_feature: GZ8MTXP02FLHIK.15.1.A01.1.454.CMB.2.raw
  modified_base (398)..(398): a, c, t, g, unknown or other
  misc_feature (398)..(398): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccacccggcagacgcccccaaactcatgatttatgaggccactaaagcgaccctcaggctttctaatcgctttctctggctccaagtctggcaacacggcctcccctgacaatctcctgggctccaggctgacgcgaggactaaatttattactgctgctcatatagaaagttaanaacacttatactattcgggcggacggaccaagctgacccgtcgtgcgtcgacgcccgaaaggcctcgcccccgtacggtacctaccttccgttcgttcccccgccccttccctaccgccttaaccggtaacgtaccgtaaggcggtccggggcgtacgggacgaaacggg

SEQ ID NO: 328453 - DNA, 692 bp, Homo sapiens
  misc_feature: GZ8MTXP02ITMR1.15.1.A01.1.454.CMB.2.raw
  modified_base (622)..(622): a, c, t, g, unknown or other
  misc_feature (622)..(622): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcacgtggaaccagcagtgagttggttggggttatcaccttgtctctgtaccaacaccacccggcacgaccaccccaatcgatgtattatgacggacactaacgaccgacccgtacgaggtcttactaactccgtcttctcgtacgctaccgtaagtcgtacggaccaacccgaccggtcccctacccgtagtaacctaacgttcctcccggtacgggtcctacccgacggtacgacggaaccggtacgggacggttaactttaaacgtttaacgttacctggtcctgtaccctaattagttaagtaaggttaaagtttaaactaaagtaccttaattacgttaaggtccgggacgggaacggaacgtaacgtccgtacgtccgtcgacgccgagacgccgtaacgccgttcccgtaccccctcggttactacccgttccgtacccgttacccccncctttcccgacgttacccgttacggaacgtaacccgttaggacggtcccgggtagacggacgaaaccggg

SEQ ID NO: 328454 - DNA, 666 bp, Homo sapiens
  misc_feature: GZ8MTXP02IFS2N.15.1.A01.1.454.CMB.2.raw
  modified_base (178)..(178): a, c, t, g, unknown or other
  misc_feature (178)..(178): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggggttatctaccttgtctcctcggtaccaaccacccgacccggcacgaccgacccctaaacncatgtatttangacggacactacgcgaccctgacggtcttactaatccggtctttcctgttcggacctccctaagcgtacggaccaaaccgtccggtccctcccctagacaacgtctccgcgggtacctcgcggacttacggaccgtcggagggttactttaaatttaaccttcgggtcntttaacgctttaaaanattagtaacgtaattaaactaactacttaagtacgtacgggtagggaccgggaagacctaggtccgtaccgttccgtcgtccgaaacgcgaacccggtccaaccggccctccccgtcccgttcgtaaccctcttccccggttcccttaaccccgccgttacccctgtacccttaagggaaccctcggacgggtcggccggtacggtcgacggacg

SEQ ID NO: 328455 - DNA, 690 bp, Homo sapiens
  misc_feature: GZ8MTXP02G3X9D.15.1.A01.1.454.CMB.2.raw
  modified_base (170)..(170): a, c, t, g, unknown or other
  misc_feature (170)..(170): n is a, c, g, or t
  modified_base (453)..(453): a, c, t, g, unknown or other
  misc_feature (453)..(453): n is a, c, g, or t
tcagtctacgtagccacgaccggtgctcgatttagacgtctcatcaggggggggagaggagcccagcactgggattccgaggtgtttccattcagtgatctgcactgaacacagaggactcgccatggagtttgggctgagctgggtttcctgttgctatttaaaaggtntccagtgtgaggtgcagctggtggagtcgtggggggaggcgttgggtccgagggcccgggggggtccctggagactctcagtgtgcaggctcgtggattcgagcgtacaggtaatagttacagtgtagttcgggtcccgcgaggctccgaggggccgaggggctaggagtggctctcaatgtaatttaccaccggtaggtcgggggacggtcgggacccaacgacttaacgacgcgaagtacgtttccggagggaagggcaaggtacttccgaacctcttacnccgaagagtaactaagttacgggaactaaaccgtaccgtagttaactttacttaaaatacgttacgaaaccgtgacccgtagaccgaaggacccgtagtaccgaacgtaccgggttcgttacggttacgtttagtttcggtaggtacggacggtaacggtaacgggttaaacggttaaagtttaaacggttacggtttaccggttacgggttaccggaccggttaacgggtccgggg

SEQ ID NO: 328456 - DNA, 748 bp, Homo sapiens
  misc_feature: GZ8MTXP02F142X.15.1.A01.1.454.CMB.2.raw
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatctaccttgtctcctacggtaaccaaccgacccgaccccggcacgaccgaccccaaactcatgtaatttanggaacggccaactaaacgccgaccctcgacggtctttactaacgtcgctttcncgtcggcctacaacgttcgtcgggaccaaaccgtacccggtcccctttacccgaggtaacctaaacgttcctcccggttaccggggtaccttcccgagggtccgtacggaaccgggtacccgggtaggtaaacctttaaattttaaccgttaaccgttgggaacctttcggtaccctttagtaaatttaaggtaaagggttaaaacggttttaataaaacctaacgtttaaacgttacgttacgttaacgggacgggtaacgggtaacaaacggttcaccggtacccgtcgtacgaccgtacgacgacccgtagcccgtccgccccgtcgtacctactcccgttcccttcccggtacccttccgtcgtaacccgttacggtaaacgccgttaaggacccgggttcgggtacaccggggacgaacgg

SEQ ID NO: 328457 - DNA, 642 bp, Homo sapiens
  misc_feature: GZ8MTXP02FGZVF.15.1.A01.1.454.CMB.2.raw
  modified_base (633)..(633): a, c, t, g, unknown or other
  misc_feature (633)..(633): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactgaaccagcagtgatgttggggttatcaccttgtctcctggtaccaacacccaccccgcacgacgacccccaaactcattgatttagtgacggtacccaactaaacgccgaccctcgacgggtctttacgtaactcgtctttcctcgtcggtcctacccgtaagtccgtcggaccaaaccgaccggcccttaccctcgaacctaacttccgtcccgttcgggcctcgacggtcacgacgcgaggacttaaattcgtactgctgactactatatacgtaagtttaacaacaattaacttaacgttcgttacgggacgggaacgggaccaaacgtcctacgtcccgttcgcgtaccgacaccggacccgaaggcccttccgcccccgtaaggtacctactcccgtcgtttccccgcttcccttaacccgcgtaacctcggtaactccgtaggccggcggtaccgngaacccggg

SEQ ID NO: 328458 - DNA, 585 bp, Homo sapiens
  misc_feature: GZ8MTXP02IOBO4.15.1.A01.1.454.CMB.2.raw
  modified_base (369)..(369): a, c, t, g, unknown or other
  misc_feature (369)..(369): n is a, c, g, or t
  modified_base (577)..(577): a, c, t, g, unknown or other
  misc_feature (577)..(577): n is a, c, g, or t
  modified_base (580)..(585): a, c, t, g, unknown or other
  misc_feature (580)..(585): n is a, c, g, or t
tcagtctacgtagccacgaccggtgctcgatttagacgtctcatcaggggtccctgagactctcatgtgcaggctctggattcagcgtcaggaatagttacatgagttgggtccgccaggccccagggcaggggctagagtggctctcaatgatttacaccgatggggacggtggaccacatactacgcagattccgtgaaggcagattcaccatctccagagacaattggagaacaccgtgattcttaatatgaacagcctgagagccgatgacgacggctgtgttatttctgtgcgagaggtacgggtataattgttactggtttcgcctacgtgggccccgaggaccctggtcagtccgtctcgtnacgccctaccgaccgacgggcccacgtccgttcccttacccccgtgcccctacccgtcccgtacaacgacgccacccgtcggtcggggaccaccgtacgggcccgtcccggtcgggtctccgaccgtggtaccaacggtccttaccgtcccgtacgtaccggttagaccgttggaacgtcgggacgtcgggacgtaacggccgaaganacnnnnnn

SEQ ID NO: 328459 - DNA, 622 bp, Homo sapiens
  misc_feature: GZ8MTXP02G2SAJ.15.1.A01.1.454.CMB.2.raw
  modified_base (310)..(310): a, c, t, g, unknown or other
  misc_feature (310)..(310): n is a, c, g, or t
  modified_base (614)..(614): a, c, t, g, unknown or other
  misc_feature (614)..(614): n is a, c, g, or t
  modified_base (618)..(622): a, c, t, g, unknown or other
  misc_feature (618)..(622): n is a, c, g, or t
tcagtctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgagtggggacggtgggaccacatactacgcagattccgtgaaggcagattcaccatctccagagactaatttggaagaacaccgtgtattacttaaatatagaacagcctagaagacgccagtcgacgacggctgtagttattttccgngtggcgaggaggtaacgggtaataaagttagtttaacgttgggtttcggactacgtcggggaccaacgggtaaccgtggtcagttcgtctccgtacgtaccgtaccccgtacccaaccgtaacgggcccctacgtcccggttccctttcccccgtcggaccctacccccttcccctaccgaaacgcgtaccacccgttcggacggggaccacgaccggccggcccgtgggctcgccgtaggtaccgaagtaccctcttaccgccttaagcgacgtcggacgtcggcgacggacaagggcacganacgnnnnn

SEQ ID NO: 328460 - DNA, 677 bp, Homo sapiens
  misc_feature: GZ8MTXP02FV7US.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcactgtctcctgtaccaacaccacccggcacgacgaccccaaatcatgtattatgacgaccactaagccgaccctgacggtcttactaactcgtcttctctggcctacctaagtcgtggacctaaccgaccggtccctccctagaacaaacttcgtccgtcggggcctacgaacggctacgacggaccgaaggtacttaaaatttagttactgtactgtactacaattagaagtaaacgttaaataaacacttaataacttacggtacggacgggaacggggaacctaaagccgtcggtaaccctccgttcgccggttacaacggacccgaacggtccctacccggtcccccgtaacggttcctaaccgtttaccgttccccgttaaaccccgtaccccttcccgttaccggtacccttaaacggttaacgttaacgtacgggaaccgggtccggtccggtacggacccgggaaacgg

SEQ ID NO: 328461 - DNA, 587 bp, Homo sapiens
  misc_feature: GZ8MTXP02HT9FR.15.1.A01.1.454.CMB.2.raw
  modified_base (319)..(319): a, c, t, g, unknown or other
  misc_feature (319)..(319): n is a, c, g, or t
  modified_base (561)..(561): a, c, t, g, unknown or other
  misc_feature (561)..(561): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaagccgaccctcagggctttctaatcgcttctctggctccaagtctggcaacncggcctccctgacaatctccgtgggtcctccgacggctacggacgacggaggacttaaagtttatttacgtgctcgctctatatagaacggttaataactactatactagttcggacggaggtaaccagctgtacccgtccgtagcgtacgacgccccgaaggcctcgcccccgttcggtcctaccgttccgtccgtttaccccctaccccttacctccgtacccgtacgtaacggtaccgnggacggtcggggctcggacgaacggg

SEQ ID NO: 328462 - DNA, 655 bp, Homo sapiens
  misc_feature: GZ8MTXP02G9249.15.1.A01.1.454.CMB.2.raw
  modified_base (260)..(260): a, c, t, g, unknown or other
  misc_feature (260)..(260): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatcaccttgtctctcgtaccaacaccacccggcagacgaccccaaactcatgattttaagngacgacacgacgccgacctacgtacggtcttactactcgtcttctcgtcgtacctactaagtcgtacgaccaaccgaccgtccctacctacgaacctaactcgtcccgtcggtcctaccgacggtacgtacggaacgtacggtaacgttaaactttaaactttacttacgtcgtacgtacgtactactaagttaagtaagttaaagttaaactaaaactaacgttaacttaacgttaacgtacggtacggaaacggaacgaacgtacgtacgtaccgtacgtacgtacgtacgacgaccgacgtccgtccgtcccgtccgtactactccttccgtaccctaccctaccgtaccgtacgtacgtaacgtacgtacggacggacggcgacgacgacg

SEQ ID NO: 328463 - DNA, 784 bp, Homo sapiens
  misc_feature: GZ8MTXP02G4NFY.15.1.A01.1.454.CMB.2.raw
  modified_base (267)..(267): a, c, t, g, unknown or other
  misc_feature (267)..(267): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactaggaaccagcagtgagtggttgggggttatctaccttgtctccgtcggtaaccaaccaccgacccggcacgaccgaccccaaactcatgtatttanaggacggacccaactaacgccgaccctacgacggtcctttactaactcgtacctttctcgtggcctaccgtaagtcgtaggaccaaccgtacccggtcccttaccctacgaacctaacttccgtcccgtcgggtccgtccgacgggtcgtacggaccgaccgggtacgggttaacttaaaactttacgttaaccgtcggtacttacgtaccctataaaggttacgttaaggggtaaaactttaaaccgtaaactaaccgttaaacttacgttaacgggttaccggggaaccgggttaaacgggaaccgttaaacggaccgttacgtaccccgggttaccgtacggtaccccggttacgaacccggtacccggaacggtcccgtaccccgtacccccggtacggttaccctacccgttccggtttaccccctacccccgtaccccttacccgggtaccctacggtaaccgtaaggtaacgttaccggggaacggtcggtaccggacggacgtaaccgg

SEQ ID NO: 328464 - DNA, 729 bp, Homo sapiens
  misc_feature: GZ8MTXP02JSI9L.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcacgaccgaccccaaactcatgtatttagtgaggaccactaaagccgaccctgacggtctttctaatccgtctttctcgtcggcctccaagtctggaccaaccgaccggtcccttacccctagaacctaacttccgtccgtcggggtcctaccgacgggtccgtaacggacggacggtacggtaacttaaacgtttaacgttactggtccttaggccttactaaagttaagtacggtaaaaggtttaaactaaactaaccttaattaacgttagggttaccggggacgggtaaacgggaaccaaaggtccgttacgacccgttaccgtcggacctaccgaaccggtacccgaacggtcccttacccggccccccgttcggttacctacccggtttcccttacccggttaaccccctaccccgttcccgtcgtacccgtttaaacggaacgttaacccgggtacgggtaccgggtcgggtaccgtacgggaaccggacgg

SEQ ID NO: 328465 - DNA, 634 bp, Homo sapiens
  misc_feature: GZ8MTXP02FKQ9K.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcagacgcccccaaactcatgatttatgaggccactaagccgaccctcgaggtctttctaatcgtctttctctggctccagtctggcaacgacggcctccctgactaatctccgtgggcctacgagcgtgacgacgagtacttaattacttactgctagctcaagttatagtaaagtttaataactactaattactagttccgggacggaaacgggaccctaaaggccgtacgtacccgttcccgtgccgtacgacgtacccgaacggtcctcccgcccccgttcgggtacctaccgtttccttcccggtttacccccgtcccctttaccccgttccggacctttaacggtaaccgtaccgttaacggaccggggttccggaccggttcgggaacgtaaccgggg

SEQ ID NO: 328466 - DNA, 769 bp, Homo sapiens
  misc_feature: GZ8MTXP02GRKBP.15.1.A01.1.454.CMB.2.raw
  modified_base (510)..(510): a, c, t, g, unknown or other
  misc_feature (510)..(510): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttgggttaggggttactctaccttgtcctccgtacgtaacccaaccacccgacccggacacgacccgacccctaaacgtctattgtaactttagaggacggtaccaacgtaacgcccgtaccccgtacggacggttcctttaacgtaacgtccgttacctttcctcgtacggtcccttaaccgtaaacggttcgtacggaaccccaaaccgtaccccggtccccttcccgtaacggtaaacctaacgtttccgtcccggttccggaccttaccggaacggctaaccggaccggtacgggacgttaacttaaacgttaattccgnggtctcgtacctagtaagttagtaagtaaacgtttaactaacgtaccttagtaacgttcggttacgggacggtaaacggaaaccgtagtcggtaacgtcccgttcgtaccgtccgaaccgtaccgaccgtaacggtcccctacccggtacccctggttaccctccgttaccggttccccttaaccccgtcccttacccggacttaccggttaactaacggtacccggtacggaccggtacggcggtaacggacggaacg

SEQ ID NO: 328467 - DNA, 727 bp, Homo sapiens
  misc_feature: GZ8MTXP02ID98R.15.1.A01.1.454.CMB.2.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagtctacgtagccacgaccggtgctcgatttagacgtctcatcagggcctgggctctgctgctcctcactctcctcactcaggacacgagggtcctgggcccagtctcgccctgactcagcctgcctccgtgtctgggtctcctggacagtcgatcaccatctcctgcactggaaccagcagtgatggttggggtatcaccttgtctccgtggtaccaacgaccacccganacgacgccccaaatcatgtatttanggagccaataagccaccctgacggtactttacaatcgtctttctctaggctacaagtctaggctaaacgacggtcctccctagaacctaatctccccgtaggggccttaccggaggtctacggacgaccgaggtacttaaagtttactaacgtcgacttcgactacgtaagtaacgtaaggttaaacgggttaaagtaaacgttaaaccgtaaattaaccttaacgtttacgggtaaccgggaacggggtaaacccgtaaaaccggacgtaccgtaacccggttaccgtaccgtccgtaccgaggtaacccccccccccccggaaggaccccgttacccgacccccgtcccgggttacccgaccgttccttacccggttcccccggtacccctttaccccgtcccgtaaccgttaaccggtaaccggtaaacgttacggacggtacggggtccggtacggaccggacgg

SEQ ID NO: 328468 - DNA, 694 bp, Homo sapiens
  misc_feature: GZ8MTXP02G3TP7.15.1.A01.1.454.CMB.2.raw
  modified_base (178)..(178): a, c, t, g, unknown or other
  misc_feature (178)..(178): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccngcagtgagttggtttggggttactctaccttggtcctcctacggtaccaaccacccgaccccggcacgaccgaccccaaatcatacgtatttagaggacggaccaagtaacgccgacccgtcgacggttctttacgtaattccgtctttccgtgtcggccttacaagtctggaacctaccgaccggtccctccctagacctatccgtccgtcggcctcgaggtcgtacggaccgacggtacggtacctttaaatttacgttacgtggtcctggtaccctaatagttaaacgtaacgggttaaattaaacttaacttaaccttaatttaaccgtttacgacggggaccggtaaacgggaccaaaggtcttccggaacccgtttcgacggacgttaccgaccgaacccgttaacgcccgttcccgggcccctacggtcctacgttcccgtaccctccctaaccctttccgacgtccttacggaacgtgtccggacggttccgacgaccgacggtaccg

SEQ ID NO: 328469 - DNA, 796 bp, Homo sapiens
  misc_feature: GZ8MTXP02IIMSW.15.1.A01.1.454.CMB.2.raw
  modified_base (268)..(268): a, c, t, g, unknown or other
  misc_feature (268)..(268): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctctgcactggaaccagcagtgtagttggttgggggttatcactttgtcctcctggtaccaaccacccacccggcacgaccgaccccctaaatcgtatgtatttagngacggtaccactaacgccgtacctcgacggtcctttactaactcgtcctttcgtcgtcggcctaccacgtcgtagggaccaaaccgcccggtcctcccgtagacctaagtcctccgtacgggcctaccgacggtcgtacgaaccggtacggtacggtactttaaactttaaccgttaccgtgtaccgttcgtctttaacattttaaagaggggttaaaacttttaacaaaaccttaccgtttaaaagttaccggttttaaacgggtccggggaaccgggaaacgggtaaacccgttaaagacccccggtttcggaacccgttttccgtaccggtaccggtaccgaaaccgggccccgtaaaacgggttcccgtaaacccccgtccccccggtttcggtaaccttccgggtttcccgtaaccccgttcccccggttcccccttaacgttccccgttaacgttaaaccggttaacggccggtttacgggtaaccggggccgggttaacccgggtacggaacggtaaccgg

SEQ ID NO: 328470 - DNA, 634 bp, Homo sapiens
  misc_feature: GZ8MTXP02ITGH1.15.1.A01.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (448)..(448): a, c, t, g, unknown or other
  misc_feature (448)..(448): n is a, c, g, or t
  modified_base (590)..(590): a, c, t, g, unknown or other
  misc_feature (590)..(590): n is a, c, g, or t
  modified_base (605)..(605): a, c, t, g, unknown or other
  misc_feature (605)..(605): n is a, c, g, or t
  modified_base (624)..(624): a, c, t, g, unknown or other
  misc_feature (624)..(624): n is a, c, g, or t
tcagtctacgtagccacgaccggtgctcgatttagacgtctcatcagggcctggggctctgctgctcctcactctcctcactcaggacacagggtcctgggcccagtctgccctgacctcagcctgcctccgtgtctgggtctcctggacagtcgatcaccatctcctgcactggaaccagcagtgatggttggggttatcacttgtctctggtaccacaccacccgnagacgccccaatnatgtattatgagaccactaacgccgacccncgacggtcctttactaactccgtctttctctaggctaccgaagttccgtagggaccaaccgaccggtccccttcccctaggtacctaaagttccgtcccgttcggggaccttcccgaggtccgtacggaaccggacggtaggtaccttaaagtttacttaccgtggccttcggactntaagttataaggtaaacggtttaactaaataccggttattaacgtagtacgggcgggaagggacccaagtcgtacgtcccgtcgtcgacctcgacgccgaaggccttccgccccgttaggtctacttccgttcggtcccccncctcctacgcgttanaacgcgtgaccgcggtacncggacgacgg

SEQ ID NO: 328471 - DNA, 779 bp, Homo sapiens
  misc_feature: GZ8MTXP02JOM28.15.1.A01.1.454.CMB.2.raw
  modified_base (296)..(296): a, c, t, g, unknown or other
  misc_feature (296)..(296): n is a, c, g, or t
tcagtctacgtagccacgaccggtgctcgatttagacgtctcatcagggggggagaggagcccagcactgggattccgaggtgtttccattcagtgatctgcactgaacacagaggactcgccatggagtttgggctgagcttgggttttccttgttgcttaatttaaaaggtgtccagtgtgaggtgcagcgtggtggaggtcgtgggggagcgttggtccgaggccggggggtccctgacgactctcagtgtgcgaggtctcgtggacttcgaggcgtacaaggaatagtaacngtggtagttcgggtccgccgaggccgtccggaggggtcgaggggactaggacgtcggctcgtactaagtacgtaacttaccgaccggtaggtccggggacggtcggaacccaacgtacgtaaccgttacggccgtaaacgggtacgttaccggtaaggggaaacggcgtaaaggtacttcccgaaacctaacttccctaaccggaaagtaacggtaaaccttaaggggttacgggaaaaacccgtaacccgtaaccgggttagtttaaaaccgtttacctttaaaagtaaccggtaagaaaaccgttacccggacgttaaacgggacgttaaacccgggcccgtaaagttcccggtaaaccggacggttacgttggttacgttacgttttcggacggtacggacggtaaaacggtacggttaaaggtaaacgttaacggttacggtttacggtacggtttaccggacgtacggggtaccgggg

SEQ ID NO: 328472 - DNA, 623 bp, Homo sapiens
  misc_feature: GZ8MTXP02IN3UW.15.1.A01.1.454.CMB.2.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagtggttgggggttatcaccttgtctctcggtaccaacaccacccggcacgaccgccccaatcatgtatttatgacgcactaacgccaccctcgaggtccttacgtaactcgtcttctctagtcctaccaagtcgtacggactaaccgaccgtccctcccctgtacgaacttcctcgtcggcctacccgagggctagaccggacgacggtactttaaagtttattaccgtggcctggtcctatagttataggttaaagtaaacttaaacacgttaactaagttcggttacggaccggggaaagggtacctaagtaccgtcgacccgttcgtcggacgtccgacgccgtaacgggcctcccgccccgtcgtcctaccgtctcccgttccctacccctctaccgctaacgtaacgcgtaacgcggcggtcgcggacacgg

SEQ ID NO: 328473 - DNA, 778 bp, Homo sapiens
  misc_feature: GZ8MTXP02JH0WT.15.1.A01.1.454.CMB.2.raw
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaggctaggtgagttggttggggttacnctaccttgtctcctggtaaccaaccacccacccgacacgaccgacccccaatcatgtacttttanacggacgtaccactaacgaccgacccgtagtaacggtctttacaacttccgctttcgtctacgggtctaccaaggtcttacggaccaaaccgcggtccctcccctagaacctagttctcccggtacggacctacggacgtaccgtacggaaccgtacgggtacgtaaacctttaaacgtttacgtacgtcgtacgtacttactagtaacgtaacgttaaaggttaaacggtttaaaacgttaaaccttaaacgttaacgttaacgttaacggttacgggtaacggggtaaacgggtaaaccgtaacggtaccggtaccggtacccggttaccgtaccgtaccgtaccgtacccggtacccggtaccggtaccgtacccggtaccccgttacccgtacctaccgttaccgttacccgttaccccgttaccccgttacccgtacccgttaaccgtacggtaacggtacggtacggtacggggtacgggtaccggtaccggtaacggaacgg

SEQ ID NO: 328474 - DNA, 552 bp, Homo sapiens
  misc_feature: GZ8MTXP01A4ADQ.41.74.G08.1.454.CMB.2.raw
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactgggtgcgccaggcccctggacaagggcttgagtggatgggtggaatcatccctnttttggctccactcacctacgcaacgagcgttccggggcagattacgattaccgcgacaagtccacagacacagtctccatgacaatgtagtttcgtttagaaacttccgaacgtacaccggccgtactacctactgtgcgaggcggtcccgttaccccagcctcggcagttggacgtccgtttgcgtagtcgttcgggggcgaacggggtaacccg

SEQ ID NO: 328475 - DNA, 590 bp, Homo sapiens
  misc_feature: GZ8MTXP01DKOR6.41.74.G08.1.454.CMB.2.raw
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctctggaagtactaccacgtcactacttataccatcaactgggtgcgcccaggccccgtcggacgaacgggcgttcggaggtgggagtggggtgggtaatcgattccccttcgttttttggtcgttcccacttcacccttaccgccaaacgacgcgttcccgggggtcaagaacttaacgacttaccggaccggacaagtccaacacgacacagtctccatgacaatagagttctttacgaaataccgacgacgaccggccgtctacctatgtgcgagaacggtcccgttacccacgcgtcgcagttggacgtcctttgaacgtagtcgttgggggcgaagggtaacccg

SEQ ID NO: 328476 - DNA, 697 bp, Homo sapiens
  misc_feature: GZ8MTXP01EM78V.41.74.G08.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgtacccctttctgcacggcctcgtggaactactacagttccactacttanaccatcaacgtgggtncgccacggcccctggacgaaggcttggagtggaggttgggtagtaagtctacgttcccttcgtttttcggccttaccaccgttcacccgtacgccaacgacgtccgtccggggacaacgtaacgttacgacgttaacccggacggaacctaagtacccaacgacgaacaccgtaacgtcctaccgaagtcgaaactaagttacgtacgttttacgtttaacgaaacgttcccggaacgaaccgtaacccgggtcccgttacctaacgttaccgtgggtacggccggtaacgggtaacccggttccccgttaaccccgacgttcccgtcgtaccgaggttcggttaccgttccggtttagaacggttacggtcgggttacggggggaacccgttaacggggtaaccccgg

SEQ ID NO: 328477 - DNA, 658 bp, Homo sapiens
  misc_feature: GZ8MTXP01BJS1O.41.74.G08.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (590)..(590): a, c, t, g, unknown or other
  misc_feature (590)..(590): n is a, c, g, or t
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgactaaccttggtcctcggtcgtaccctttcngcacggcctntggaagtacactagttccatactanaccatacaacgtgggtncgccgacggcccctaggacagggcttagaggtggagtgggtggaattcgacttcccttcttttcggctccacctcgaccgtacgcgaaaccgtacgtaaccgttccggggactaacgtaacgttaccgaacgttacccgacgggaactaacgtccaacacggtaaccaacgagttacctaccagtacgaacgaagttgtaaacgtttcgtttaacgaaactccggaaccgtaacgcccggaccgtttactacgtacgttcgtacgggccggtagggtaacccgggtcccgttaaccccggngttaccgtcgacgttacgttcggttacttccgttagaacgtcggtgggacgggtccgaacggtaaccg

SEQ ID NO: 328478 - DNA, 517 bp, Homo sapiens
  misc_feature: GZ8MTXP02FQBT2.41.74.G08.1.454.CMB.2.raw
  modified_base (331)..(331): a, c, t, g, unknown or other
  misc_feature (331)..(331): n is a, c, g, or t
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtctaccagttccactacttataccatcaactggtgcgccaggcccctggacaaggcttgagtggatggtggaatcgatcctnttttgctcactcactacgcacgagcttccggggcagaattacgattaccgcggtacaagtcccacagacacagtctaccatgacaatgagttctttagaaatccgaacgacacgccgtctactactgtgcgagacggtccctacccagctcgcacgtgagccttgacgatcgtggggcaggacccg

SEQ ID NO: 328479 - DNA, 618 bp, Homo sapiens
  misc_feature: GZ8MTXP02FMEKN.41.74.G08.1.454.CMB.2.raw
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagtctatactatcacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtacccctttcctgcacggtcctcgtaggaacgttactacctagttccactacttataccatcaacgtggtgcgccacggcccctaggacaggnttgaggtggagtggtaggatcacttcctnttttcggctccactcaccgtcncacgacgtcgtccgggacaagtaacttacgtataccgcgaacaacgtccacgagacacacgtcctacagtgaactaagtagtagtttacgtagaacgtacccgaacgaccgccggtaccgtacttaccgtacgtgacggacgtacggtacccggtaccccgtacccgacgtccgtacgacctacggtcggtaccgttcgtttagaacggttacgtccgggtacggggtaccggtaccgggttaacccgg

SEQ ID NO: 328480 - DNA, 437 bp, Homo sapiens
  misc_feature: GZ8MTXP01A7D84.38.41.D08.1.454.CMB.2.raw
  modified_base (280)..(280): a, c, t, g, unknown or other
  misc_feature (280)..(280): n is a, c, g, or t
  modified_base (423)..(437): a, c, t, g, unknown or other
  misc_feature (423)..(437): n is a, c, g, or t
tcagtcgatcacgtcacgaccggtgctcgatttagtcacgcgagaaagggaaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactgggggccacggaaccctggtcaccgtcncctcagcctcaccaagggcccatcggtctccccctggcacccctcctcaagagcacctctgggggcacgagcggccccctgggctgccctggtcaagggctacttccacgtgatcgactgagcgggctggcaaggcgcatagnnnnnnnnnnnnnnn

SEQ ID NO: 328481 - DNA, 434 bp, Homo sapiens
  misc_feature: GZ8MTXP01BJ0YI.38.41.D08.1.454.CMB.2.raw
  modified_base (282)..(282): a, c, t, g, unknown or other
  misc_feature (282)..(282): n is a, c, g, or t
  modified_base (427)..(427): a, c, t, g, unknown or other
  misc_feature (427)..(427): n is a, c, g, or t
  modified_base (430)..(434): a, c, t, g, unknown or other
  misc_feature (430)..(434): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtgggggccacggaaccctggtcaccgtcncctcagcctccaccaagggcccatcggtcctcccctggccacccctcctccaagcgcacctcgtgggggcacgagccggcccccgtgggctgcctcggtacaaggctactcacgtgatcgactgagcggctgggcaaggcgacanagnnnnn

SEQ ID NO: 328482 - DNA, 432 bp, Homo sapiens
  misc_feature: GZ8MTXP01AWWPM.38.41.D08.1.454.CMB.2.raw
  modified_base (280)..(280): a, c, t, g, unknown or other
  misc_feature (280)..(280): n is a, c, g, or t
  modified_base (421)..(421): a, c, t, g, unknown or other
  misc_feature (421)..(421): n is a, c, g, or t
  modified_base (427)..(432): a, c, t, g, unknown or other
  misc_feature (427)..(432): n is a, c, g, or t
tcagtcgatcacgtcacgaccggtgctcgatttagtcacgcgagaaagggaaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactgggggccacggaaccctggtcaccgtcncctcagcctccaccaagggccccatcggtcttccccctggcacccctcctccaagagcacctctgggggcacagcggccccctgggctgcctggtcaagggctacttcccacgtgatcgactgagcgggctgggcaaggcncatagnnnnnn

SEQ ID NO: 328483 - DNA, 536 bp, Homo sapiens
  misc_feature: GZ8MTXP01BWO4F.38.41.D08.1.454.CMB.2.raw
  modified_base (517)..(523): a, c, t, g, unknown or other
  misc_feature (517)..(523): n is a, c, g, or t
  modified_base (525)..(536): a, c, t, g, unknown or other
  misc_feature (525)..(536): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactacgtggggcccacggaaccctggtcacccgtctcctcacgccctccaaccgaaacgggccccatccggtcccttccccccgtcggccacccctccctaccaagacgccaccctcgtgggggccacgacggccggccccccgtggggctacggcccgtggttaaccgaaacgggtcccttacctttccccgaacggttacgaacttccgggaaccttgggacgggccggggtccgtcggggaccgaaacggggccgaccgtaagtaggnnnnnnngnnnnnnnnnnnn

SEQ ID NO: 328484 - DNA, 432 bp, Homo sapiens
  misc_feature: GZ8MTXP01A1RCQ.38.41.D08.1.454.CMB.2.raw
  modified_base (281)..(281): a, c, t, g, unknown or other
  misc_feature (281)..(281): n is a, c, g, or t
  modified_base (427)..(432): a, c, t, g, unknown or other
  misc_feature (427)..(432): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccacggaaccctggtcaccgtcncctcagcctccaccaaagggcccatcggtcttccccctggcacccctcctccaagagcacctctgggggcacgagcggccccctggggctgccctggtcaaggctacttccacgtgatcgactgagcgggctggcaaggcgcatannnnnn

SEQ ID NO: 328485 - DNA, 456 bp, Homo sapiens
  misc_feature: GZ8MTXP01D7LNR.38.41.D08.1.454.CMB.2.raw
  modified_base (448)..(456): a, c, t, g, unknown or other
  misc_feature (448)..(456): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactcgggggccacggaaccctggtcaccgtctcctcacgcctccaccaacgggcccactccggtccttccccctcggccacccctccctccaagacgccacctcgtgggggcacgacgccggcccccgtggggctcgccctggtaccaaggctacttccacgtgatcgactgacgcgggctggcgaaggcgacatagnnnnnnnnn

SEQ ID NO: 328486 - DNA, 578 bp, Homo sapiens
  misc_feature: GZ8MTXP01DJH3M.38.41.D08.1.454.CMB.2.raw
  modified_base (540)..(545): a, c, t, g, unknown or other
  misc_feature (540)..(545): n is a, c, g, or t
  modified_base (547)..(578): a, c, t, g, unknown or other
  misc_feature (547)..(578): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccacggaaccctggtccacccgtctcctcacgccctccaaccgaacgggccccagtccggtcccttcccccctggcccacccctccctaccaaagacgccaccctccggtcgggggaccacgacggcccggccccccgttggggctcggcccgtagggtaaccaaacgggtcccttaccctttaccccgacgttcgacgttacccggacgttacgggaacgggcccgggggtaccgtacgggggaccccgaaaagggggcccgtacctaaagtaacggcgnnnnnngnnnnnnnnnnnnnnnnnnnnnnnnnnnnnnnn

SEQ ID NO: 328487 - DNA, 506 bp, Homo sapiens
  misc_feature: GZ8MTXP01EZWJJ.38.41.D08.1.454.CMB.2.raw
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
  modified_base (490)..(506): a, c, t, g, unknown or other
  misc_feature (490)..(506): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacgagtatagcagcagctctgactacgtggggccacggaaccctggtcaccgtcncctcacgcctccaccaacggcccatccggtccttccccctggccncccctcctccaacgacgccacctcgtgggggccacgacggccggccccccgtggggctcggcccgtgggtaaccgaaacgggtccttaccgtttcccgaacggttcgaacgttccggaacgttcgggacggccggggcgtcggggacgaaacgggcgacagtagnnnnnnnnnnnnnnnnn

SEQ ID NO: 328488 - DNA, 547 bp, Homo sapiens
  misc_feature: GZ8MTXP01DDDNT.38.41.D08.1.454.CMB.2.raw
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
  modified_base (525)..(531): a, c, t, g, unknown or other
  misc_feature (525)..(531): n is a, c, g, or t
  modified_base (533)..(547): a, c, t, g, unknown or other
  misc_feature (533)..(547): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtanagcagcagctctgactacgtcggggaccaccggaccctggtccaccgtcncctcacgccctacccaaccgaacgggccccacttcccggtccccttccccccgtcggccctaccccctccctacccgaaacggacgccctaacccgtccggtcggggggaccacgacggccggtccccccgtcggggctcggtcccgtgggtaaccaacggtccttacccgttacccgacggtacgtacgtaccgaacgtcggacgggcggggtcgacgggcgaaacgggccgacgaatgnnnnnnngnnnnnnnnnnnnnnn

SEQ ID NO: 328489 - DNA, 427 bp, Homo sapiens
  misc_feature: GZ8MTXP02H9BLS.38.41.D08.1.454.CMB.2.raw
  modified_base (421)..(427): a, c, t, g, unknown or other
  misc_feature (421)..(427): n is a, c, g, or t
tcagtcgatcacgtcacgaccggtgctcgatttagtcacgcgagaaagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccacggaaccctggtcaccgtctcctcagcctccaccaagggcccatcggtcttccccctggcacccctcctccaagacgcacctctggggcacagcggcccctgggctgcctggtcaaggctacttccacgtgatcgactgagcgggctggcaaggcgcatagnnnnnnn

SEQ ID NO: 328490 - DNA, 419 bp, Homo sapiens
  misc_feature: GZ8MTXP02HJWP5.38.41.D08.1.454.CMB.2.raw
  modified_base (417)..(419): a, c, t, g, unknown or other
  misc_feature (417)..(419): n is a, c, g, or t
tcagtcgatcacgtcacgaccggtgctcgatttagtcacgcgagaaagggaaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtcttccccctggcacccctcctccaagagcacctctggggcacagcgccccctgggctgctggtcaaggctacttccacgtgatcgactgagcggctggcaaggcgcatagnnn

SEQ ID NO: 328491 - DNA, 425 bp, Homo sapiens
  misc_feature: GZ8MTXP02H9UJW.38.41.D08.1.454.CMB.2.raw
  modified_base (420)..(425): a, c, t, g, unknown or other
  misc_feature (420)..(425): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccacggaaccctggtcaccgtctcctcagcctccaccaagggcccatcggtccttccccctggccacccctcctccaagagcacctctggggcacagcgccccctgggctgcctgtcaaggctacttcacgtgatcgatgagcggctggcaaggcgcatagnnnnnn

SEQ ID NO: 328492 - DNA, 454 bp, Homo sapiens
  misc_feature: GZ8MTXP02F65DC.38.41.D08.1.454.CMB.2.raw
  modified_base (445)..(454): a, c, t, g, unknown or other
  misc_feature (445)..(454): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtcaccgtctcctcacgcctccaccaacgggccccatccggtccttcccccctggcccacccctccctaccaagacgccaccctcgtcggggccacaggccggccccctggggcctgcctggtaccaaggcctactcccagtgatcgatgagcgggctggcaaggcgcatagnnnnnnnnnn

SEQ ID NO: 328493 - DNA, 549 bp, Homo sapiens
  misc_feature: GZ8MTXP02G7VJG.38.41.D08.1.454.CMB.2.raw
  modified_base (253)..(253): a, c, t, g, unknown or other
  misc_feature (253)..(253): n is a, c, g, or t
  modified_base (472)..(472): a, c, t, g, unknown or other
  misc_feature (472)..(472): n is a, c, g, or t
  modified_base (506)..(506): a, c, t, g, unknown or other
  misc_feature (506)..(506): n is a, c, g, or t
  modified_base (511)..(549): a, c, t, g, unknown or other
  misc_feature (511)..(549): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggaccacggccctctattactggtgcgagagatcaggacggtagtaatagcaagccagcctntgactacggtcggggacccaacggaacccctggtcaccgtctcctcgacgccctaccaccgaacgggcccctagttccggttaccccttccccgcggccctaccccgtccctacgaacgcacccaccgtcggtcggggacacgacggcccggccccgtcgggcctcgcccgtgggtaccaacggtccttaccttaccggacttacggactaccgtacgnggtacggtcgggtctacgggaacgaaggcccganagagnnnnnnnnnnnnnnnnnnnnnnnnnnnnnnnnnnnnnnn

SEQ ID NO: 328494 - DNA, 636 bp, Homo sapiens
  misc_feature: GZ8MTXP01BOG6B.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctctggaagcgcctccaacattggcacgaatatgtatcctggtaccagcacgttacccggacacgacccccaaactcctacatctatagaagtacttttaccgcgtaccctcgacgggtacttccgtcggccgtattcctctcggctaccaaagtcacggcctacctctcgcccaccgtcggacactccgacccgggcctccgaacggaccggggacgacggacccgtattacgttacgtcgtaccgactaaacgttcgggaaccctacccgtaaccgttacgtacgttggggttcgggggtccgtttccggggcgggtaaggggttacttaaacggttcgtacccggtccttacggttccacggccccgaaggcctccggcccccgttcggtccaacctttcccg

SEQ ID NO: 328495 - DNA, 584 bp, Homo sapiens
  misc_feature: GZ8MTXP01BPQSF.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaagcgcctcaacattggcacgaattatgtactcctggtaccagccacgttccccggacacgacccccaaactcctacatctatgaacgtactttacgcgaccctcgacggtacttcgtggcccgtattcctcgtcggctaccgaaagtcacggccacctctcgcccaccctggacactccgacccgggctccgacggaccggggacgacggcgtattagttacgtgaccgacgtaacgttcggacctccaaaccgtgtacgttggttcgggtctttcgggcggttagggtacttaggtcgaccgttccgttcgttcaagcccaaggcctcgcccctcggttctccg

SEQ ID NO: 328496 - DNA, 589 bp, Homo sapiens
  misc_feature: GZ8MTXP01EZATB.10.86.H09.1.454.CMB.2.raw
  modified_base (460)..(460): a, c, t, g, unknown or other
  misc_feature (460)..(460): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggaagcgcctccaacattggcacgaatatgtatcctggtaccagcacttacccggacacgcccccaaactcctcatctatgaatatttacgcgaccctcgaggtaccttccgtggccgtattcctacgtcggcctaccgaaagtcacggcctacctctcgcccacccgtggaaccatccgacccgggctacccgacggaccggggacgacgccgtaattacttacgngcgactaacgttcggacctccgaacgtgtacgtggttcgggtcgttcgggcggtaagggttacgttaagttcgaccgtccgttacgttcacggcccacggtctccgccccgttcggtccaaccgttccg

SEQ ID NO: 328497 - DNA, 625 bp, Homo sapiens
  misc_feature: GZ8MTXP01B2BDM.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggcccaggacagaggtcaccgtctcctgctctggaagccgcctaccaacattggcacgaatatgtatcctggtaccagccacttacccggacacgacccccaaatcctacatctatgaagtatttacgccgaccctcgagggtaccttccgtggcccgtattctccgtcggcctaccgaaagtccacggccaccctctcgcccacccgtggacacgtccgacccgggcctaccgaacgggacccggggacgacggacccgtaattacgttacgtcgcgacctaacgttcggacctccaaccgtcgacgtcgggttcggggtccgtttcgggcgggtaacgggttacgttaacggttcggaacccgttccgttacgttccgacgcccgaacggtcctccggcccccgttcggtccttccgttcccg

SEQ ID NO: 328498 - DNA, 536 bp, Homo sapiens
  misc_feature: GZ8MTXP01ADICP.10.86.H09.1.454.CMB.2.raw
  modified_base (240)..(240): a, c, t, g, unknown or other
  misc_feature (240)..(240): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaancgcctccaacattggcacgaattatgtatcctggtaccagcacttccccgggacacgcccccaaactcctcatctatgaagattttacgcgaccctcacggggattctggccgattctctggctccaagtcaggcactctcgccaccctggacatcaccgggctccagaccggggacaggccgattacgtactgcgcaacttggactccaactgtactgttggggctttcggcggagggacttaagtgaaccgttccttacgttcaagcctaaggctcggcccctcggttctaacc

SEQ ID NO: 328499 - DNA, 615 bp, Homo sapiens
  misc_feature: GZ8MTXP01B432C.10.86.H09.1.454.CMB.2.raw
tcagcatagtagtgcacgaccggtgctcgatttagtgctatagacttgggtttggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggcccaggacagaggtcaccgtctcctgctctggagcgcctcaacattggcacgaatatgtatcctggtaccagccaccttccccggacacgcccccaaactcctcatctatgaatatttacgcgacctcagggtacttcctgccgtattctctcgctccaagtcagcactctcgccacctggacatccaccgggctccgaggaccggggacgacggcccgtaatttacttaacgtcggccgactaaaccgtttcgggaaccttcccgaaaccgtcggaccgttgggttcgggggtccgtttcggggcgggtaacgggttaccttaaacggttcgaaaccccgttccgttacggttccaaccggccccgtaaacgggtcctcccggcccccgttcgggtcccttaaccgttccccg

SEQ ID NO: 328500 - DNA, 484 bp, Homo sapiens
  misc_feature: GZ8MTXP01A0ZC3.10.86.H09.1.454.CMB.2.raw
  modified_base (478)..(484): a, c, t, g, unknown or other
  misc_feature (478)..(484): n is a, c, g, or t
tcagcatagtagtgcacgaccggtgctcgatttagtgctatagacttggggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctcgccaccctggacatccgaccgggctccgaggaccgggggacgacggccgtattatactgcgacaacgttgggacctccaacctgacttggttggggtctttcgggcggagggtacttaagtcgaccgtcctaccgtcacgcccaaggcctcgccccctggtccacgtctccgttccccacccctcctacccactactatcgctgagcgggcgtggcaaggcgcataggnnnnnnn

SEQ ID NO: 328501 - DNA, 450 bp, Homo sapiens
  misc_feature: GZ8MTXP01E1B8H.10.86.H09.1.454.CMB.2.raw
  modified_base (442)..(442): a, c, t, g, unknown or other
  misc_feature (442)..(442): n is a, c, g, or t
  modified_base (445)..(450): a, c, t, g, unknown or other
  misc_feature (445)..(450): n is a, c, g, or t
tcagcatagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccaggaccggggacgaggccgattatactgcgcaacttggactccaacctgactgttggggctttcggcggaggactaagtgaccgtctacgtcagccccccaaggctcgccccctcggtcactctcgttccccgccctcctccactactatcgctggagcgggctgggcaaggcgcanagnnnnnn

SEQ ID NO: 328502 - DNA, 632 bp, Homo sapiens
  misc_feature: GZ8MTXP01A0WRK.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctcgccggccccaggacagagggtcaccgtctcctgctcgtggaacgcgcctccaacattggcacgaattatgtactccgtgtaccagccaccgttccccgggacaccgacccccaaactccctacactctatagaacgtacttttaccgcgtaccctcgacgggtacttcgtcggcccgtactttctcgtcggcctacccgaagtccacggcctacctctcgcccacccgtcggacacgtccgaccgggctaccgacgggaccgggacgacggccgtattacggtacgtcgccgactaacgttcggacctaccgaaccgttgtaccgttggttcggggtcgtttcggggcgggaacgggtacttaacggttcgtaccgttcccgttacgttcgaacggtcccgaacggcctccgccccgttccgttccgtcccg

SEQ ID NO: 328503 - DNA, 536 bp, Homo sapiens
  misc_feature: GZ8MTXP01B2BCC.10.86.H09.1.454.CMB.2.raw
  modified_base (241)..(241): a, c, t, g, unknown or other
  misc_feature (241)..(241): n is a, c, g, or t
  modified_base (399)..(399): a, c, t, g, unknown or other
  misc_feature (399)..(399): n is a, c, g, or t
  modified_base (531)..(531): a, c, t, g, unknown or other
  misc_feature (531)..(531): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagcccgccctcagtgtctgcggccccaggacagagggtcaccgtctccttctctggaancgcctccaacattggcacgaatatgtatcctggtaccagcacttccccgggacacgcccccaaactcctcatctatgaagtattttacgcgtaccctcgagggtacttcctggcccgattctctggcctcaagtcaggcacctctcgccacctggacntccacccgggctccgaggaccggggacgacggccgattacttacgtgcgcaacgttgggacctccaactgactgtgggcttggcggaggactagttcgaccgtcacgttcacgccagctcgccccttcgtcnctccg

SEQ ID NO: 328504 - DNA, 650 bp, Homo sapiens
  misc_feature: GZ8MTXP01ED0A5.10.86.H09.1.454.CMB.2.raw
  modified_base (243)..(243): a, c, t, g, unknown or other
  misc_feature (243)..(243): n is a, c, g, or t
tcagcatagtagtgcacgaccggtgctcgatttagtgctatagacttgggtttggggctctgcttcagctgtgagcgcagaaggcgggactcgggacaatcttcatcatgacctgcctcccctctcctcctctcccttctcattcactgcacagggtcctgggcccagttctttgttgacgcagccgccctcagtgtctgccggcccaggacagagggtccaccgtctcctgctcgtggaacnccgccctaccaacattggcacgaatatgtatcctggtaccagccaccttccccggacacgcccccaaactccctcatctatagtaagtacttttacgccgaccctcgacgggtaccttcccgtggcccgtatttcctcgtacgggtcctaccgaaagtccgacggtcctaccctctccgaccccacccgtcggacctacgtccgacccgggtacctacccgacgggacccggggacgacggccgtaatttactacgtgccgtactaacgtcggacctaccaccgtagtacgttgggttcggggtcgtttcgggcggtaagggttaccgttaacggttcgacccgttccgttaccgttcaccgcccgaaggccctccggcccccgttcggtaaccttccgtttccccg

SEQ ID NO: 328505 - DNA, 654 bp, Homo sapiens
  misc_feature: GZ8MTXP01E041C.10.86.H09.1.454.CMB.2.raw
  modified_base (265)..(265): a, c, t, g, unknown or other
  misc_feature (265)..(265): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagcccgccctcagtgtctgccggccccaggacagaggtcaccgtctccttctctggaagcgcctccaacattggcacgaattangtatcctggtaccagcaccttccccgggacacgcccccaaactcctcatctatgaagtattttacgccgaccctcgagggacttcccctggccgattctctcggcctccaaagtcaggcacctctcgcccaccctgaccactcgaccgggctacccgaggaccggggacgacggccgtaattacgttaccgtgggtccgactaaaccgttcgggaacctccccgaaaccgtgtaaccgttggttacgggggtccgtttccggggccgggtaaggggtaaccgttaaagggttccggacccgttcccgtaacggttccgacgacccccggaacgggtcccttcccggcccccccgttcgggttaccctaaccgtttcccgtttcccccgg

SEQ ID NO: 328506 - DNA, 446 bp, Homo sapiens
  misc_feature: GZ8MTXP01A3KDO.10.86.H09.1.454.CMB.2.raw
  modified_base (439)..(446): a, c, t, g, unknown or other
  misc_feature (439)..(446): n is a, c, g, or t
tcagcatagtagtgcacgaccggtgctcgatttagtgctatagacttgggtttgggggctgtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccgaggaccgggggacgaggccgattatactgcgcaacttgggactccaactgactggttggggctttcgggcggagggacttaagtcgaccgtcctacgtcacgcccaaggctcgccccctggtcccactctcgttccccaccctccctcccaactactatcgctggacggcgggctggcgaaggcgcatagnnnnnnnn

SEQ ID NO: 328507 - DNA, 575 bp, Homo sapiens
  misc_feature: GZ8MTXP01DVTGI.10.86.H09.1.454.CMB.2.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (445)..(445): a, c, t, g, unknown or other
  misc_feature (445)..(445): n is a, c, g, or t
  modified_base (562)..(562): a, c, t, g, unknown or other
  misc_feature (562)..(562): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctccctctcctcctctccttctcattcactgcacagggtcctgggcccagtctttgttgacgcagccgccctcagtgtctgcggccccaggacagaggtcaccgtctccttntctggaancgcctccaacattggcacgaattangtatcctggtaccagcaccttccccgggacacgcccccaaactcctcatctatgaagtattttacgcgaccctcgaggacttcccctggcgtattctctcggctccgaagtcacggcacctctcgcccaccctggacactccaccgggcctaccgacggaccggggacgaggccaattattacnggcgactaacgtcgggacctcccaaacgtcgacgttggttcgggtcgtttcgggcggtaagggtacttaaggttcgaccgtcctacgttcgcgccgaaggcctcgcccctggttccncgttcgttccccg

SEQ ID NO: 328508 - DNA, 676 bp, Homo sapiens
  misc_feature: GZ8MTXP01EZ868.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacaggtcctgggcccagtctttgttgacgcagccgccctcagtgtctgcggcccaggacagagggtcaccgtctcctgctcgtggaagccgcctccaacattggacacgaattatgtatcctggtaccagcacctccccggacacgcccccaaatcctacatctatagaagtattttaccgcgaccctcgaacgggtacttccgaggcccgtattcctcgtgggccttaccgaaagttccgaggccacctctccgcccacccgtggaccactcgaacccgggctaccgaacgggaccggggacgaacgggtacccgtatttaacgttacgtcggaccgaccgtaacgtttccgggaccttacccgtaaaccgtggtaccgttggggtttcggggtcgtttccggggacgggttaacggggtaacgtttaacggttccggtaaccccgttccgttaccggttccgaaccggccccgaaacggggtcccttacccgggcccccccgttcggggttccctaaccccgg

SEQ ID NO: 328509 - DNA, 633 bp, Homo sapiens
  misc_feature: GZ8MTXP01D0SYE.10.86.H09.1.454.CMB.2.raw
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggancgcctccaacattggcacgaattangtatcctggtaccagcaccgttccccgggacacgacccccaaactcctacatctatagaagtattttaccgcgtaccctgacggtacttcgnggccgtattcnctcggctaccaagtcacggcacctctcgcccacctggacactcgacccgggtctaccgacgggaacccgggacgacggacccgtaagtttacgttaacgtggaccgtacgtaacgttcgggaacctacccgtaaaccgtgtacgttcgggttcgggggtccgtttcgggacgggttagggtacgttaaaggttcggtacccgttaccgttacgttcgaaccgcccgtaacgggtcctcccggttccccgttcggttcctaaccccg

SEQ ID NO: 328510 - DNA, 466 bp, Homo sapiens
  misc_feature: GZ8MTXP01BJ6EK.10.86.H09.1.454.CMB.2.raw
  modified_base (456)..(456): a, c, t, g, unknown or other
  misc_feature (456)..(456): n is a, c, g, or t
  modified_base (458)..(466): a, c, t, g, unknown or other
  misc_feature (458)..(466): n is a, c, g, or t
tcagcatagtagtgcacgaccggtgctcgatttagtgctatagacttggggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatccacccgggctccgaggacccggggacgaggccgattattactgcgcaacgttgggactccaacctgactggttggggctttcgggcggagggactaagttgaccgtcctacgtcagcccaggctcgcccctggtcactctcgttccccaccctcctccactactatgctgagcgggctggcaaggcgcatagngnnnnnnnnn

SEQ ID NO: 328511 - DNA, 641 bp, Homo sapiens
  misc_feature: GZ8MTXP01EQQVP.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgcctcccctctcctcctctcccttctcattcactgcacagggtcctgggcccagtctttgttgacgcagccgccctcagtgtctgccggcccaggacagaggtcaccgtctcctgctcgtggaacgccgcctccaacattggcacgaattatgtatcctggtaccagcaccgttcccccgggacaccgacccccaaactcctacatctatagtaagtacttttaccgccgaccctcgacgggtacttccgtcggcccgtattcctcgtcggtcctaccgaaagtcacggtccaccctctccgccctacccgtggacacgtccgaacccgggtcctaccgacgggacccggggacgacggaccgtagttacgttacgtcgccgacgtaacgttcgggaccctaccgtaaaccgtcgtacgttggttcggggtcgtttcggggacgggttagggtacgttacgtcgtacccgttccgttacgttcgaacgtcccgaacggtccgtccgttccccgtcgttccgtccc

SEQ ID NO: 328512 - DNA, 451 bp, Homo sapiens
  misc_feature: GZ8MTXP01E0PQ8.10.86.H09.1.454.CMB.2.raw
  modified_base (444)..(451): a, c, t, g, unknown or other
  misc_feature (444)..(451): n is a, c, g, or t
tcagcatagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccaggaccggggacgaggccgattatactgcgcaactggactccaacctgactgttggggctttcggcggaggactaagttcgaccgttcacgtcagccccccaaggctcgccccctggtccactctcgtccccgccctcctccactactatgctgagcgggctgggacaaggcgcatagnnnnnnnn

SEQ ID NO: 328513 - DNA, 632 bp, Homo sapiens
  misc_feature: GZ8MTXP01APQWF.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggcccaggacagaggtcaccgtctcctgctctggagccgcctccaacattggcacgaattatgtatcctggtaccagccaccgttccccgggacaccgacccccaaactcctacactctatagaaagtacttttaccgccgtaccctcgacgggtacttccgtcggtcccgtatttcctcgtcggcctacccgtaagtccacggcctacctctcgcccaccctggaccactccgacccgggctaccgacggaccggggacgacggaccgtattacgtacgtcgacgactaacgttcggacctaccgaaccgtgtacgttcgggttcgggtccgtttcgggacgggttagggtaacttaaggttccgaacccgttccgttacgttccaacggcccgaacggtcctccggcccccgttcggttcctaacccg

SEQ ID NO: 328514 - DNA, 658 bp, Homo sapiens
  misc_feature: GZ8MTXP01EWX0R.10.86.H09.1.454.CMB.2.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (399)..(399): a, c, t, g, unknown or other
  misc_feature (399)..(399): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgtgacgcagccgccctcagtgtctgccggccccaggacagaggtcaccgtctccttnctgancnctcantgcagatngtatctggtaccagcaccgtccccggacacgacccccaaactcctacatctatgaagtacttttacgcgtaccctcgagggtacttccccgtggccgtattcctcgtcggctccgaaagtccaggccacctctcgccctacccgtgacncgtccgacccgggctacccggaggacccggggacgacggtcccgtaattacttaccgtcggggacgtaccgtaaaccgtttcgggaaccctacccgtaaaccgttcggtaaccgttggggttcgggggtacgtttccggggcggggtaaacggggtacgttaaagggttccgttacccggttcccgtaacgggttccacggaccccgaagggtcccttcccggcccccgttcgggttccctaaccgttccgttccccgg

SEQ ID NO: 328515 - DNA, 579 bp, Homo sapiens
  misc_feature: GZ8MTXP01BKQSL.10.86.H09.1.454.CMB.2.raw
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
tcagcatagtagtgcacgaccggtgctcgatttagtgctatagacttgggtttggggctctgcttcagctgtgagcgcagaaggcgggactcgggacaatcttcatcatgacctgctccctctcctcctctcccttctcattcactgcacagggtcctgggcccagtctttgttgacgcagccgccctcagtgtctgccggccccaggacagaggtcaccgtctcctgctctggancgcctcacntgcacgatngtatctgtacngcacgtcccggacacgccccaaatccncatctatgaagtatttaccgccgtaccctgacggtacttccgtggccgtattctctcggctaccaaagtcaggtccacctctcgcccaccgtggacacgtccgacccggtcctaccgacggaaccggggacgacggccgtaatttacgtaacgtcgtaccgacctaaacgttcgggaccctaccaacgtacgtacgttggttcgggtcgtttcgggaacggtagggttactaagttcgaccgtccttacgttcacgcccagccgtccgccccgttgtccaacttccg

SEQ ID NO: 328516 - DNA, 492 bp, Homo sapiens
  misc_feature: GZ8MTXP01AZ613.10.86.H09.1.454.CMB.2.raw
  modified_base (480)..(480): a, c, t, g, unknown or other
  misc_feature (480)..(480): n is a, c, g, or t
  modified_base (482)..(492): a, c, t, g, unknown or other
  misc_feature (482)..(492): n is a, c, g, or t
tcagcatagtagtgcacgaccggtgctcgatttagtgctatagacttgggggggtgagggttgagaacctatgaacattctgtaggggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccaccctggacactcgacccggggctccgacggaccggggacgaggcccgtattacttactgcgacaacttgggacctcccaacctgacgtggttgggggcgtttcgggcggagggtactaagtcgaccgtcctaccgtcacgcccaggctacgcccctcggtcacctctccgtccccgccctcctccactactatcgctgagcgggcgtggacgacggcgacagtagngnnnnnnnnnnn

SEQ ID NO: 328517 - DNA, 697 bp, Homo sapiens
  misc_feature: GZ8MTXP01BP7KZ.10.86.H09.1.454.CMB.2.raw
  modified_base (244)..(244): a, c, t, g, unknown or other
  misc_feature (244)..(244): n is a, c, g, or t
tcagcatagtagtgcacgaccggtgctcgatttagtgctatagacttgggtttggggagctctgcttcagctgtgagcgcagaaggcgggactcgggacaatcttcatcatgacctgcctcccctctcctcctctcccttctcattcactgcacagggtcctgggcccagttctttgttgacgcagcccgccctcagtgtctgccgaccccaggacagaggtcaccgtctcctgctcgtggacnccgcctccaacattggcacgaattatgtactcctggtaccagccaccgttccccgggacaccgacccccaaactcctacatctatagaagtactttaccgcgtaccctcgacgggtacttccgtggcccgtatttccctcgtcggccttacccgaaagtccaacgggtccacccttctcgccctacccgtggacctacgtcccgaacccgggcctaccgaacgggacccggggacgacggccgtaactttacggtacgtcggccgacgtaaaccgttcgggaacccttacccgaaaccgttcgtaaccgttgggttccgggggtcgtttcgggggacgggttaagggtaccgttaacggttaccggtaccccgttacccgttacgttacccgaaccggtaccccgtaacgggtccctcccggttaccccccgttcgggttcccgttaaccccg

SEQ ID NO: 328518 - DNA, 494 bp, Homo sapiens
  misc_feature: GZ8MTXP01DOMS9.10.86.H09.1.454.CMB.2.raw
  modified_base (471)..(471): a, c, t, g, unknown or other
  misc_feature (471)..(471): n is a, c, g, or t
  modified_base (473)..(480): a, c, t, g, unknown or other
  misc_feature (473)..(480): n is a, c, g, or t
tcagcatagtagtgcacgaccggtgctcgatttagtgctatagacttgggggggtgagggttgagaacctatgaacattctgtaggggtcaccgtctcctgctctggaagcgcctccaacattggcacgaattatgtatcctggtaccagcacttccccgggacagcccccaaactcctcatctatgaagatttttacgcgaccctcagggattcctggccgattctctggctccaagtcaggcacctctcgccaccctggacatcaccgggctccgaggacccgggggacgaggcccgtattattacgtgccgcaacttgggacctccaacctgtactggttgggggtctttcgggcggagggtactaaggttcgaccgtcctaccgtcacgcccaaggctcgcccctgtcactctcgtccccgcctctccactactatcgctgacggcggactggcgaaggcgcatagngnnnnnnnntttttttttttttt

SEQ ID NO: 328519 - DNA, 733 bp, Homo sapiens
  misc_feature: GZ8MTXP01DGMK4.10.86.H09.1.454.CMB.2.raw
  modified_base (253)..(253): a, c, t, g, unknown or other
  misc_feature (253)..(253): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctccttctcattcactgcacagggtcctgggcccagttctttgttgacgcacgcccgccctcagtgtctcgccggccccaggacaggacgggtccaccgtctcctgctctggacgccgccncaactattggacacgaattatgtatccgtcggaccacgcaccgttaccccggacaccgaccccaactcctcatctatagaactatttacgcgtacctcgacggtcttacgtggtcctagttcctcgtcggacctaccgaagttcgacggctacctcctacgcccaccgttcggactactccggaacccgggcctcccggaacgggaccccgggggacgaaccgggtaccgttaagtttaacgggtttacccgtacggtaccgtaccgtaaaacgttcccggggtaacccttacccgtaaaccggtccggttaacggttcggggtttacgggggttcccgtttccgggggtaacgggttacggggtaaaccgttaaacggttccggtaacccggtttacccgttacggttacccaaccggtaaccccggtaacggtccccggttacccggttcccccgttccgggttccctttaaccccgg

SEQ ID NO: 328520 - DNA, 703 bp, Homo sapiens
  misc_feature: GZ8MTXP01A1WX8.10.86.H09.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagttctttgttgacgcagccgccctnagtgtctgccggcccaggacngagggtcaccgtctcctgctcgtggaagccgccctaccaactattggacacgaattatgtatccgtaggtaccacgctaccgttccccgggaacacgacccccaaactccctacactctaatcgtaaagtacttttaccgccgtaccctgacgggtacttccgtggcccgtattcctacgtcgggcctaccgaaagtccgaacgggtccacccgttcgtccgccctaaccccgtggaacctacgtcccgaacccgggcctaccggacgggacccggggacgtacggtaccgtaacgtttacgttaaccgtcggtaccgacctaaccgggtacgggtacccttacccgtaaaccgttcgtacgtttcggggtcggggttcggtttccggggcgggttaagggtacgttaacggttccgaacccggttcccgttaacggttccaacggcccgtaacgggtcctcccgggcccccttcgggttcccttcccg

SEQ ID NO: 328521 - DNA, 719 bp, Homo sapiens
  misc_feature: GZ8MTXP01EM4SY.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgcctcccctctcctcctctcccttctcattcactgcacagggtcctgggcccagtctttgttgacgcagcccgccctcagtgtctgccgccccaggacagaggtcaccgtctcctgctcgtggaacgccgccctaccaactagttcggacaacgtaattatgtactccgtaggtaccagccaccgttcccccgggacaccgaccccccaaactcccctacactctatagtaaagtacttttaccgccgaccctcgacgggtaccttccgtggcccgtattccgtctcggctaccaagtcacggcctacctctcgccctaccgtcggacacgtccgacccgggtcctaccgacgggaccgggacgacgacgtacttacgtaccggtcgacgtaccgtaacgtttacgggaacctacccgtaacgtacggtaccgttcgggttacgggggtccgtttcggggaaccgggtaacgggttaaccgttaaacgggtttaccggtaaccccgtttcccgttaaccggttccgacccggtaacccccgtaaacgggtcccttaccccgggtccccccggttaccggttccccgttaacccgttttccccgg

SEQ ID NO: 328522 - DNA, 623 bp, Homo sapiens
  misc_feature: GZ8MTXP01AW8ML.10.86.H09.1.454.CMB.2.raw
  modified_base (368)..(368): a, c, t, g, unknown or other
  misc_feature (368)..(368): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcaccgtccccgggacacgcccccaaactcctcatctatgaagtattttacgccgtaccctcgacggtattccgtaggcccgattccnctggcctcccaagtcaggcctacctctcgccacccgtggacacgtcgaccggctccgacggaccggggacgacggcccgaattacgttacgtcgaccgtctaaaccgttcgggaccctccgaaccttcggtaacgttcgggtttcggggcgttttcgggcgggttaggggtaccgttaagttcgggtacccgttccgttacgttcgaaccgcccgtaaggcccgtcccgcccccttaacgggttcccttaacccg

SEQ ID NO: 328523 - DNA, 723 bp, Homo sapiens
  misc_feature: GZ8MTXP01DQ527.10.86.H09.1.454.CMB.2.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
tcagcatagtagtgcacgaccggtgctcgatttagtgctatagacttgggtttggggagctctgcttcagctgtgagcgcagaaggcgggactcgggacaatcttcatcatgacctgcctcccctctcctcctctcccttctcattcactgcacgagggtcctgggccctagttcttttgtcgacgcacgcccgccctnagtgtctcggccggcccaggacaggaggtcaccgtctctgctcgnggaacgccgcctacaactagttcggacaacgtaattagtgttactccgtacggtaaccacgactacccgttccccgggacaccgaccccctaaactcctacactctaagtagtaaacgtactttaccgccgtacccgtgacgggtacttcgtcggccgttacttcctacgtcggtacctacgaacgttccgacggtacctaccgtctccgaccctacccgtaggacctacgttacccggacccgggtaccgaccggaacgggggacccggggaacgacggtaacccgtacgtttaacgttaccggtcggtaccgtaacggtaaccgttccggggtaaccctaccgtaaacccggtgtaccggttgggttacggggtcgttaacggggacgggttacgggtacgttacggtcgacccggttacgttccgttacgtaaccgccgtaacggtcccgtccggttccccgttcggccttccccg

SEQ ID NO: 328524 - DNA, 728 bp, Homo sapiens
  misc_feature: GZ8MTXP01B2GGI.10.86.H09.1.454.CMB.2.raw
  modified_base (240)..(240): a, c, t, g, unknown or other
  misc_feature (240)..(240): n is a, c, g, or t
  modified_base (360)..(360): a, c, t, g, unknown or other
  misc_feature (360)..(360): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctccttctcattcactgcacagggtcctgggcccagtctttgttgacgcagccgccctcagtgtctgccggccccaggacagagggtcaccgtctcctgctctggacnccgcctccaacattggcacgaattatgtatcctggtaccagctaccgtccccgggacacgacccccaaactcctcatctaatgaacgtattttacgccgaccctcgacggggtattccgngggcccgtattcctctcgggcctccaaagttccacgggcctactcctcggccctaccccgtggacctactccgaacccgggtcctacccgacgggaacccggggacgacgggaccccgtaagtttacgttaacgtcggccggacgttaaaccgttccgggggaaccttacccgtaaacccgttacggtaacccgttgggtttccgggggtccttttccgggggaccgggggttaacggggtaacgtttaaaccgggttacggtaaccccggtttcccggttaccgggttacccgtaaccgggacccccgtaacggggttccccgttccggttacccccccccggtttcgggttcccctttaaccccgg

SEQ ID NO: 328525 - DNA, 536 bp, Homo sapiens
  misc_feature: GZ8MTXP02GTMNZ.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggacttcctggccgattctctggctcaagtcagcacctctcgcccaccctggacatcaccgggctccgaggacccggggacgacggccgtattacttactgcgcaacgttggactccaactgactgtgggctttcggcggagggactaacgttcgaccgtcctacgtcagcccgaggctcgccccgtcggtcactccg

SEQ ID NO: 328526 - DNA, 542 bp, Homo sapiens
  misc_feature: GZ8MTXP02I6WM7.10.86.H09.1.454.CMB.2.raw
  modified_base (525)..(525): a, c, t, g, unknown or other
  misc_feature (525)..(525): n is a, c, g, or t
tcagcatagtagtgcacgaccggtgctcgatttagtgctatagacttgggtttggggctctgcttcagctgtgagcgcagaaggcgggactcgggacaatcttcatcatgacctgctcccctctcctcatctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacacgcccccaaactcctcatctatgaagtactttacgcgaccctcacgggtacttccgtgccgtattctctggctcaagtcagcactctcgccaccctgacatccaccgggctccacggaccgggacgaggccgattactactgcgacaacgttcggactccgaactgaccttggttcggggctttcgggcggagggactaagttcgaccgtcctacgtcaagcccaaggccncgccccctcggctaccg

SEQ ID NO: 328527 - DNA, 567 bp, Homo sapiens
  misc_feature: GZ8MTXP02JMSZ8.10.86.H09.1.454.CMB.2.raw
tcagcatagtagtgcacgaccggtgctcgatttagtgctatagacttgggtttggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgattatgtatcctggtaccagcacttccccgggacacgcccccaaactcctcatctatgaagtattttacgcgaccctcaggacttcctggccgattctctggcctccaagtcagcacctctcgcccaccctggacatccacccgggctccgagaccggggacgacggccgattattactgcgacacgttcgggacctccaaccgtgaccgttggttggggtcgtttcgggcggtacgggacgtaacggttcgaccgtccgtaacgtccgaacgcccgaaacggcctaccgccccctcggtccacttcccg

SEQ ID NO: 328528 - DNA, 631 bp, Homo sapiens
  misc_feature: GZ8MTXP02HZSP1.10.86.H09.1.454.CMB.2.raw
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
tcagcatagtagtgcacgaccggtgctcgatttagtgctatagacttgggtttggggctctgcttcagctgtgagcgcagaaggcgggactcgggacaatcttcatcatgacctgctccctctcctcctctcccttctcattcactgcacagggtcctgggcccagtctttgttgacgcagccgcctcagtgtctgcggccccaggacagagggtcaccgtctcctgctctggaancgctccaacattggcacgaattatgtatcctggtaccagcacttaccgggacagcccccaaacncctcatctatgaaagtatttacgccgaccctcaggacttcctgcgattcnctgctccaagtcagcacctctcgcccaccctaggacacnccgaacccggctaccgaaggacccgggggaaccgaggacccgtagttaactttaaccgtcgaccgacgtaacggttacgggacctaacccgaaccgtacgacgttcgggtttacggggtccgtttccggggacggggtaaacgggtaacgttaaacggttaccggtacccggttaccgtaccggtacgaaccggaacccgaacggtcccgtacccgtcccccgtccggtacctaccgtcccg

SEQ ID NO: 328529 - DNA, 424 bp, Homo sapiens
  misc_feature: GZ8MTXP02HBDUE.10.86.H09.1.454.CMB.2.raw
  modified_base (385)..(385): a, c, t, g, unknown or other
  misc_feature (385)..(385): n is a, c, g, or t
  modified_base (419)..(424): a, c, t, g, unknown or other
  misc_feature (419)..(424): n is a, c, g, or t
tcagcatagtagtgcacgaccggtgctcgatttagtgctatagacttgggtttgggggctgtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtctacgtcagccaaggctgccccctggtccactctgtcccgccctcctccnctactatgctgagcgggctggcaaggcgcatagnnnnnn

SEQ ID NO: 328530 - DNA, 601 bp, Homo sapiens
  misc_feature: GZ8MTXP02I5BJV.10.86.H09.1.454.CMB.2.raw
  modified_base (242)..(242): a, c, t, g, unknown or other
  misc_feature (242)..(242): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctcgtggaacncgccctaccaacattggcacgaattatgtactcctggtaccagcctaccgttccccggacaccgacccccaaactccctacactctaatgaagtatttaccgccgaccctcgacgggtacttccgtcgccgtattccttcgtcggcctaccgaagtccacggccacctctcgcccacccgtggacacgtcccgaccggcctaccgacggacccgggacgacggaccgtattactacgtgacacgtaacgtcggacctaccaacgtgtacgttggtcgggtcgttcgggacgggtaggtactaggtcgaccgtaccgtacgtcgaacgacccgaaggcctccgccccgtcggtactaccg

SEQ ID NO: 328531 - DNA, 644 bp, Homo sapiens
  misc_feature: GZ8MTXP02JYPKU.10.86.H09.1.454.CMB.2.raw
  modified_base (458)..(458): a, c, t, g, unknown or other
  misc_feature (458)..(458): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttacccgggacacgcccccaaactccctcatctatgaaagtattttacgcgtaccctcagggtacttcctggccgtattcctctggctaccaagtcagcacctctcgcccacccgtggacatccgacccgggctacccgacggacccggggacgacggaccgtattacgtttaccnggcgacaacgttcgggacctacccgaacctcgaacgttgggtttcgggggtcgttttccggggcgggtaacggggtaccttaaaacgggtttcggaacccggttacccgtaaccggttaccgaacggcccccgaaacggggtcccgtccggtccccccccgttcgggtccctaacccgtttccccg

SEQ ID NO: 328532 - DNA, 675 bp, Homo sapiens
  misc_feature: GZ8MTXP02JE3IA.10.86.H09.1.454.CMB.2.raw
  modified_base (240)..(240): a, c, t, g, unknown or other
  misc_feature (240)..(240): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaanccgcctccaacattggcacgaattatgtatcctggtaccagcacttacccgggacacgacccccaaactcctcatctatgaaagtattttacgccgaccctcgacgggtaccttccgtcggccgtatttctcgtcggcctaccgaaagtccgacggccacctctcgcccacccgtggacactccgacccgggctacccgacggacccgggggacgacgggacccgtaatttacgttaacgtcggaccgaccgtaaacgttcggggacccttacccgaaaccgttcggtaacgtttcgggttcgggggtaccgttttcggggaccggggtaagggtaccgttaaacggttcggtaaacccgttcccgtaccggtaccgaaccggtccccgaacggtcccgtacccggccccccgtcggtaccctaccgtttccccg

SEQ ID NO: 328533 - DNA, 644 bp, Homo sapiens
  misc_feature: GZ8MTXP02I0UMS.10.86.H09.1.454.CMB.2.raw
tcagcatagtagtgcacgaccggtgctcgatttagtgctatagacttgggtttggggctctgcttcagctgtgagcgcagaaggcgggactcgggacaatcttcatcatgacctgctcccctctcctcctctcccttctcattcactgcacagggtcctgggcccagtctttgttgacgcagcccgccctcagtgtctgccggccccaggacagagggtcaccgtctcctgctcgtggacgccgccctccaacattggcacgaattatgtatcctggtaccagcaccgtacccggacacgacccccaaactcctcatctatagaatactttaccgcgaccctgacggtacttccgtgcctattctcgtcgcctaccaaagtccacgcctacctctcgcccacccgtcggactactacccggacccggctacccgaacgggaaccccgggggacgtaccggaccgttaaattacgttaccgtcgaccgactaacggttcgggaaaccctcccgaaacctcgtacgttgggttcgggtccgtttcgggacgggtacgggtaacgttaaacggttccgaacccgttccgtaaccggtcaacggaaccccgaacggtccctccggccccctcggtaccacctttcccg

SEQ ID NO: 328534 - DNA, 665 bp, Homo sapiens
  misc_feature: GZ8MTXP02I61HO.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtatcctggtaccagccacttccccggacacgccccaaactcctcatctatgaagtacttttaccgccgaccctcgacgggtacttccgtggccgtattcctcgtggcctccaagtcacgcacctctcgcccaccctggacactccgaccgggcctaccgacggaccggggacgacggaccgtaatttacgttacgtgaccgtacgtaaaaccgtttcggggaacccttacccgaaacccgttcggtaccgttgggtttcgggggtccgttttcgggggacggggtaacggggtaccgttaaaggttccggtaacccggttccgtaaccggttaccgaaccggtccccgaaaacgggtcccttacccgggtccccccgttacggggtacccttaaccccgg

SEQ ID NO: 328535 - DNA, 610 bp, Homo sapiens
  misc_feature: GZ8MTXP02FGTKG.10.86.H09.1.454.CMB.2.raw
  modified_base (177)..(177): a, c, t, g, unknown or other
  misc_feature (177)..(177): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (354)..(354): a, c, t, g, unknown or other
  misc_feature (354)..(354): n is a, c, g, or t
  modified_base (466)..(466): a, c, t, g, unknown or other
  misc_feature (466)..(466): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgtnacgcagccgcctcagtgtctgccggcccaggacagagggtcaccgtctcctgctctggaagcgcctccaacattggcacgaattangtancctggtaccagcacttccccgggacacgcccccaaactcctcatctatgaagtacttttaacgcgacccctcacggggtacttccgnggccgattcctctgcctcaaagtcagcacctctcgcccaccccgtagggacaactccgaaccccgggctacccgaacgggacccgggggacgacgggcccgaattacttacngccgacaaaccgtttcggggacctccaaacccttgaaccgtggttgggggctttcgggcgggagggtaactaaacggttcgaacccggttccctaacggttccaacggaccccgaaacggcctccgcccccttcggcctacccg

SEQ ID NO: 328536 - DNA, 625 bp, Homo sapiens
  misc_feature: GZ8MTXP02H82NO.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctccctctcctcctctcccttctcattcactgcacagggtcctgggcccagtctttgttgacgcagccgccctcagtgtctgccggcccaggacaggaggtccaccgtctcctgctcgtggaagccgccctacccaactagttggcaacgtaattatgtatcctggtaccagcctaccgttcccccgggacaccgacccccaaactccctacactctatagaatactttaccgccgtaccctagaccgggtacttccgtcggccgtattccgtctcggccttacaacgtcacgccactctcgcccaccgtgacactccgaccggctaccgacggaccgggacgacggaccgtattactacgtgcgactaacgtcggaacctaccgtacgtgtaccgtgggttcggggtccgtttcgggacgggtacgggtaacgttaacggtcgtaccgtaccgttaccgcgtaaccgcccgaacggtccgtaccgtcccccggtacgtaccgtcccg

SEQ ID NO: 328537 - DNA, 692 bp, Homo sapiens
  misc_feature: GZ8MTXP02ITYK5.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggagcgcctcaacattggcacgaattatgtatcctggtaccagccacgttccccgggacaccgacccccaaactcctcatctatagaatactttacgccgtaccctcgacggtacttccgtggccgtacttcctcgtcggtaccttccaaacgttccgacgggtcctacccgttcctccgccccaacccgtcggaacctacgtcccgacccggggtccctacccggacggggaaccccgggggaccgacgggtaccccgtaagtttaacgttaacgttcgacccgtaccgtaaaccgttcggggaaccctacccgtaaccgtcgtaccgtttgggttcggggttccgtttacgggacggggtaacgggtacgttaaacggttcggtaccccgttaccgttaccgtaccgaaccgaccccgaaggtcccgtacccgtcccccgttcggtaccttacccg

SEQ ID NO: 328538 - DNA, 626 bp, Homo sapiens
  misc_feature: GZ8MTXP02H2PE3.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctccctctcctcctctcccttctcattcactgcacagggtcctgggcccagtctttgttgacgcagccgcctcagtgtctgcggcccaggacagaggtcaccgtctcctgctctggaagcgcctcaacattggcacgaattatgtatcctggtaccagccacttcccccgggacacgacccccaaactcctcatctatgaagtatttaccgcgaccctcgacgggtacttccgtaggcccgtatttccgtccgttgggccttaccaaagttccgaagggcccacccttctacgcccacccgtggacactccgaccgggctaccgacggacccggggacgacggccgtattacttacgtgcgacaacgttggaacctaccaaccgtcgaacgttggttcggggtcctttcggggaccgggtagggtaacctaaagggttcgaacccgttcccgtacgtaccaacggaccccgaaagggtccctaccgtccccccgtcggttacccctccg

SEQ ID NO: 328539 - DNA, 557 bp, Homo sapiens
  misc_feature: GZ8MTXP02J0TC1.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtatcctggtaccagcacttccccgggacacgcccccaaactcctcatctatgaagtattttaccgcgtacccctcgacgggtacttccgtggccgtattctctggcctccaaagtccagccacctctcgcccacccgtggaccagtccacccgggctccgaggacccggggacgacggcccgattactacgtcgcgcaacgttgggacctccgaactcgacgtggttgggctttcggcggtaggactaggtcgacgtctacgtcacgccgaggctcgcccctcggtcactccg

SEQ ID NO: 328540 - DNA, 610 bp, Homo sapiens
  misc_feature: GZ8MTXP02G6B2J.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggagcgcctccaacattggcacgaattatgtatcctggtaccagccaccttccccgggacacgcccccaaactccctcatctatgaagtattttaccgcgaccctcgagggtacttccgtggcccgtattcctcgtcggcctaccaagtccaggccacctctcgcccaccctggacactccgacccgggcctccgacggaacccggggacgacggacccgtaattacgttacgtacgcgacaacgttcgggaccctccgaaccgtgaccgttggttggggtctttcggggacggacgggtacgtaaacggttcgacccgtaccgtaccgtcgacgcccgaaggtccgtccgcccccgtcggtacctacgttcccg

SEQ ID NO: 328541 - DNA, 623 bp, Homo sapiens
  misc_feature: GZ8MTXP02G7MK1.10.86.H09.1.454.CMB.2.raw
  modified_base (355)..(355): a, c, t, g, unknown or other
  misc_feature (355)..(355): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggagccgcctcaacattggcacgaattatgtatcctggtaccagcaccgttccccggacacgcccccaaactcctacatctatagaaatactttacgccgtacctgacggtaccttccgngcctattctcgtcggcctcgaaagtccgagcctacctcgtcgaccctaccctcggaaccacgtcccgacccgggcctacccgacgggaacccggggaacgacggacccgtaaatttaccgttaacgcggaccgaccgtaacggttacggacccttaccgaaaccgttgtaccgttgggttcgggtaccgtttcgggacggtacggtacttaacggtcgacccgtctacgtcacgaaccgagccgtcgccccgtcgtacctacgttccg

SEQ ID NO: 328542 - DNA, 678 bp, Homo sapiens
  misc_feature: GZ8MTXP02GR14I.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccggacacgcccccaaactcctcatctatgaagtatttacgcgaccctcgacgggacttcctggccgattcctctggcctccaagtcaggcacctctcgcccacccgtgaccatccaccgggctccgacggacccgggggacgacgggacccgtaattacgttaacttcggccgacgtaaacgttccggggaaccttacccgtaaacccgttcggaaccgttcgggttacgggggtccttttacgggggaccggggtaaacggggtaaccggttaaacggtttacggtacccccggttacccgttaaaccggttccgaaaccgggtacccccgaaaacgggggtccccgtaaccggtacccccccgttccggggttacccttaacccccgg

SEQ ID NO: 328543 - DNA, 658 bp, Homo sapiens
  misc_feature: GZ8MTXP02JSZYF.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctccctctcctcctctcccttctcattcactgcacagggtcctgggcccagtctttgttgacgcagccgccctcagtgtctgccggccccaggacaggagggtcaccgtctcctgctctggaacgccgcctccaacattggcacgaattatgtatcctggtaccagccaccttccccgggacacgacccccaaactcctacatctatacgaagtacgttttaccgaccgtaccctcggagggtaccttccgtggccgtattctcgtgggtcctaccgaaagtccgaacggtccaccctctccgacccacccgtgacgactccgacccgggctacccgacgggaccgggggacggacggtaccgtaagttacgttacgcggcgacgtaacgttcgggacctacccaacgtcgtaacgttgggttacggggtcgtttcggggacgggtacgggtacgttacggtcggtacccgtaccgtaaccggtcaccggaaccggaacggtcccgtccggtacccccgttcgggtacctaccgtttccccg

SEQ ID NO: 328544 - DNA, 687 bp, Homo sapiens
  misc_feature: GZ8MTXP02ICSF2.10.86.H09.1.454.CMB.2.raw
tcagcatagtagtgcacgaccggtgctcgatttagtgctatagacttgggtttggggagctctgcttcagctgtgagcgcagaaggcgggactcgggacaatcttcatcatgacctgctccctctcctcctctcccttctcattcactgcacagggtcctgggcccagttctttgttgacgcagccgccctcagtgtctcgccggccccaggacaggagggtccaccgtctcctgctcgtggaacgccgccctaccaacattcggcaacgtaattatgtactcctggtaccagccaccgttccccgggacaccgacccccaaactcctacactctatagaagttactttaccgccgtaccctcgacggtacttccgtcggaccctatttcctcgtcggccttaccaaacgttccgacgtcctacccttccgtaccgaccccaccccgtacggaccctacgtcccgacccggggtcctacccggaaccgggaacccgggggacggacggtaccgtaaattacgttacgtcgaccgacgtaaccgttacgggaccctacccgaaccgtacggtacgttcgggttcggggtaccgtttcgggacggggtaacgggtacgttaaacgggtcgtacccgtaccgttaccgtcgaaccgacccgacgcctcccgtccccgtcggtcctacccg

SEQ ID NO: 328545 - DNA, 689 bp, Homo sapiens
  misc_feature: GZ8MTXP02GEZ4T.10.86.H09.1.454.CMB.2.raw
  modified_base (261)..(261): a, c, t, g, unknown or other
  misc_feature (261)..(261): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagaggtcacgtctcctgctctggaagccgcctcaacatggcacgaattntgtatcctggtaccagccaccgttccccggacaccgacccccaaactccctacactctatacgaagttacttttaaccgccgtaacccctcgaacgggtacttccgtcggtacccgtatttcctcgtcgggtcctaccgaaagtccacggcctaccctctccgacccacccgtaggaccacgtcccgacccgggcctacccgacgggacccggggaacgacggtaccgtaatttacgttaccgtgacccgtacgtaaccggtaccgggtaacctacccgtaaccgtacggtaccgttggggtttcggggtccgtttaccggggacgggtacggggtaacctaaaggttccggtacccgtacccgtacggtaccgtaaccggaccccgaaacggtccccttaccggtcccccgtcggtacccttcccgg

SEQ ID NO: 328546 - DNA, 710 bp, Homo sapiens
  misc_feature: GZ8MTXP02FKT6W.10.86.H09.1.454.CMB.2.raw
  modified_base (495)..(495): a, c, t, g, unknown or other
  misc_feature (495)..(495): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctccctctcctcctctcccttctcattcactgcacagggtcctgggcccagtctttgttgacgcagccgccctcagtgtctgccggcccaggacagaggtcaccgtctcctgctctggagcgcctaccaacattggcacgaaattatgtactcctggtaccagccaccgttccccggacaccgacccccaaactcctactactctatagaagtacttttacgaccgtaccctacgacgggtacttcccgtacggccgtacttcctcgtcggcctaccgaacgtcgacggcctaccctctccgaccctacccgtggacactccgacccgggcctaccgaacggacccggggacgacggtacccggtaattacgttacgngtaccgaccgtaaacgttccgggaaccttacccgtaaccgttacggtaccgttggggtttcgggggtccgtttaccgggggacggggtaaacggggtaccgtttaaacgggttaccggtaccccggttacccgttaaccggttaccgaaccggacccccgtaaacggggtcccttaccccgggtacccccccgtttccgggtacccttaccccgg

SEQ ID NO: 328547 - DNA, 754 bp, Homo sapiens
  misc_feature: GZ8MTXP02H1D8Y.10.86.H09.1.454.CMB.2.raw
  modified_base (357)..(357): a, c, t, g, unknown or other
  misc_feature (357)..(357): n is a, c, g, or t
tcagcatagtagtgcacgaccggtgctcgatttagtgctatagacttgggtttgggggctctgcttcagctgtgagcgcagaaggtgggactcgggacaatcttcatcatgacctgctcccctctcctcctctcccttctcattcactgcacagggtcctgggcccagtctttgttgacgcagccgcctcagtgtctgcgcccaggacagaggtcaccgtctcctgctcgtggaacgcgcctccaacattggcacgaattatgtatcctggtaccagcaccgttccccggacacgcccccaaactcctacatactatagaaagtactttacgacctaccctcgacggtacttcccgnggaccgtactttcgtcgtcggccttacccgaaagttccgaacgggccctaacccgtccgttaccggacccctacccgttacggaacctacgttaccgaaccgttcggggaccgtcccggaaaccgggaacccgggggaacgaacgggtaccggtaactttaacgttacgttacggaccgtaccgtaaaccgttgggaacccttacccgtaaacgttcggtaaccgttcggggtttacgggggtcccgttttacgggggaccgggttaacggggtaaacccgtttaaaacgggttcccggttaaccccggttacccgtttacccggtaaccggtaaccggtaaccccgaacgggtccccgtaccggtacccccccggtccggtttaacccgtaccccg

SEQ ID NO: 328548 - DNA, 637 bp, Homo sapiens
  misc_feature: GZ8MTXP02F0UD0.10.86.H09.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctctggaancgcctcaacattgcacgaattatgtatcctggtaccagccaccgttccccgggacacgacccccaaactccncatctatagaaagtacttttacgcgacctcgagggacttccgtgccgtattctctggcctccaagtcacgcacctctcgacccaccctggaacactcgaacccggtctcccgaacggacccggggacgacggccgtaacttaacttacgtcgccgactaacgttacgggtaccctaccgtaacgtcggtaccgttggttcggggtcgtttaccgggacgggtaacggtacttaaacggttacgacccgttccgttaaccgtaccgaaccgtaaccccgaaacggtcccgtacccggtccccccgtcgggtcctacccgtttccccg

SEQ ID NO: 328549 - DNA, 685 bp, Homo sapiens
  misc_feature: GZ8MTXP02H9SGE.10.86.H09.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctccctctcctcctctcccttctcattcactgcacagggtcctgggcccagtctttgttgacgcagccgcctcagtgtctgcggcccaggacagagggtcaccgtctctgctctggancgctcantgcanatngtancnggtaccngcacgtccggacacgccccaatccnatctatagaatactttacgccgtacctgaggtaccttccgtacggccgtattccgtccgttacggccttacccgaaagttccgaaacgggtccccctaacccttcgttcccgggacccctaaccccgttacggggtaacccaacggttcccggaaaccccggggtccgttaccccggaaacggggaaccccgggggaacgtaccgggacccggtaaatttaaccgttaacgttcggaccgtacgtaaacgtttcgggaaccttaccgaacgttcgaacgttggttcggggtcgtttcggggacgggtagggtaccgttaaacggtccgtaaccgttccgtaccgtacaccggtaacccgaacggtcctccggcccccgtacggtcctaccgtttcccg

SEQ ID NO: 328550 - DNA, 531 bp, Homo sapiens
  misc_feature: GZ8MTXP02G7MF8.10.86.H09.1.454.CMB.2.raw
  modified_base (514)..(531): a, c, t, g, unknown or other
  misc_feature (514)..(531): n is a, c, g, or t
tcagcatagtagtgcacgaccggtgctcgatttagtgctatagacttggggggtgagggttgagaacctatgaacattctgtagggggtcaccgtctcctgctctggaagcgcctccaacattggcacgaattatgtatcctggtaccagcaccttccccgggacacgcccccaaactcctcatctatgaagtattttacgccgaccctcgagggtacttccgtggccgtattctcgtggcctaccaagtcaggcacctctcgcccacccgtggacactcgaccggggctcccgaggacccgggggacgacgggcccgtattacttactgccgactaacgttcgggacctcccaactgacgtggttggggctttcgggcggaggactaagtcgaccgtctaccgtcacgcccaaggctccgcccccgtcggtccacctcctccgtcccccaccctcctacccactactatcgctggacggtcgggcgtcgggacgaacgggccgacgtagaggnnnnnnnnnnnnnnnnnn

SEQ ID NO: 328551 - DNA, 490 bp, Homo sapiens
  misc_feature: GZ8MTXP02HCIEV.10.86.H09.1.454.CMB.2.raw
  modified_base (441)..(441): a, c, t, g, unknown or other
  misc_feature (441)..(441): n is a, c, g, or t
  modified_base (479)..(490): a, c, t, g, unknown or other
  misc_feature (479)..(490): n is a, c, g, or t
tcagcatagtagtgcacgaccggtgctcgatttagtgctatagacttgggtttgggaacctatgaacattctgtagggggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgcccaccctggacatccgaccggggctcccgaggacccgggggacgaggcccgattattctgcgcaacgttgggacctccaacctgaccgtggttggggctttcgggcgggaggtactaaggttgacccgtctacgtcacgcccccgaaggcctcgccccctggtccactctcgttccccgccctcctccactactacncgctggacgcggggctcgggacgaacgggcgcaagtgnnnnnnnnnnnn

SEQ ID NO: 328552 - DNA, 851 bp, Homo sapiens
  misc_feature: GZ8MTXP02I5G95.10.86.H09.1.454.CMB.2.raw
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcacgcccgccctcagtgtctgccggccccaggacagagggtcaccgtctcctgctctggagcgcctccaacattggcacgaattatgtatcctggtaccagcaccttccccggacacgacccccaaactcctcactctatagtaacgtacttttaccgcgtaccctcgtaacgggtaccttccgtcggtccgtatttccgtccgtcgggtccttacccgaaaacggttccgaacggggtcccctaacccgtttccgttaccgacccccgtaacccccgttacgggaaaccctaacgttaccccggaacccccgggggtacccttaacccccgggtaacggggaaacccccggggggaaccggaaaccggggtacccccggtaaaagttttaaccgtttaaccgttacggcccgtaacccgttaaaccgggtttaccggggtaaaccccttaccccggtaaacccgttacggtaaccggtttcgggggtttaccgggggttccggttttacccgggggaccgggggttaaacgggggttaaaccgtttaaacggggtttcccggtaaccccggtttacccgttaaacccggttccgaaccggtaaccccggaaaacgggtcccgttaccccggtccccccggttaccgggttaccctacccgttttcccccg

SEQ ID NO: 328553 - DNA, 590 bp, Homo sapiens
  misc_feature: GZ8MTXP02I8DFJ.10.86.H09.1.454.CMB.2.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
  modified_base (464)..(464): a, c, t, g, unknown or other
  misc_feature (464)..(464): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgtgacgcagccgccctcagtgtctgccggccccaggacagagggtcaccgtctctgctctggancgcctcaacattggcacgtaattatgtatcctaggtaccacgccaccgttccccgggacacgacccccaaactcctcactctatgtaacgtatttaccgccgtaccctcgacggtcttccgtcggccgtattccgtactggcctacgaagtcacgcacctctcgccacctgacnctccgaccggctaccgaggaccgggacgacggtaccgtattactacgtgacncgtaacgttcgggacctaccgactgtacgttgggtcgggtcgttcgggacggaggtacctaaaggttcgaacccgttcgtacgtacaacgacccgaacggtccgtccgtccccctcggtctacccg

SEQ ID NO: 328554 - DNA, 641 bp, Homo sapiens
  misc_feature: GZ8MTXP02JGROQ.10.86.H09.1.454.CMB.2.raw
  modified_base (272)..(272): a, c, t, g, unknown or other
  misc_feature (272)..(272): n is a, c, g, or t
tcagcatagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagttctttgttgacgcagccgccctcagtgtctgccggccccaggacaggacggtcaccgtctcctgctctggaacgcgcctaccaacattcggacacgaattangtactccgtaggtaccagcctaccgttccccgggacaccgacccccaaactccctacatctatagaacgttactttaccgccgtaccctcgacggtacttccgcgaccgtattctctggcttaccgaaagtcgacgctaccctctaccgcccacccgtaggaccacgtcccgacccgggcctaccgaacgggacccggggacgacggtaccgtaatttacgtacgtcgacgaccgtaacgttgggaaccctaccgaacgtcgtacgttcgggtacgggtcgtttacggggacggtacggtacgtaagttaccgtaccgtaccgtacgtcgaacgcccgtaacggcgtcccgtcccgtcggtacctaccg

SEQ ID NO: 328555 - DNA, 678 bp, Homo sapiens
  misc_feature: GZ8MTXP02I7XA9.10.86.H09.1.454.CMB.2.raw
  modified_base (239)..(239): a, c, t, g, unknown or other
  misc_feature (239)..(239): n is a, c, g, or t
tcagcatagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagcccgccctcagtgtctgccggccccaggcagagggtcaccgtctcctgctctggancgcctccaacattggcacgattatgtatcctggtaccagcaccgttccccgggacacgcccccaaactcctcatctatgaaatattttacgcgaccctacagggacttccctggccgtattctctcggcttaccgaagtcaggccacctctcgcccacccgtggacacgtccgacccgggctacccgaggacccgggggacgacgggacccgtaatttacgttacgtcgacgacctaacgtttcgggaaccttacccaacttcgtaaccgttcgggtttcggggtaccgttttcgggacgggtaacggggtaaccgttaacgggtttacggaaaccccggtttcccgttaaaaccggtcccgtaaccggaaccccgtaaaaccggggtccgttacccggcccccccggtttaccgggtccctaaacccgttttcccccg

SEQ ID NO: 328556 - DNA, 504 bp, Homo sapiens
  misc_feature: GZ8MTXP01EN14Q.10.64.F09.1.454.CMB.2.raw
  modified_base (195)..(195): a, c, t, g, unknown or other
  misc_feature (195)..(195): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
  modified_base (477)..(477): a, c, t, g, unknown or other
  misc_feature (477)..(477): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgcaggagaaatttgtgttgacacagtctccagccacctgtctttgctcagggaangccacctctcctgcagggccagtcagagtgttagcactaacttagtctaggtaccaacagaaacctggccaggctccaggctctcatctatgatgcatccacgagggccactggcatcccagccaggtcagtggcagtggtctgggacngacttnactctcacatccaccgctagaccctgaagatttgctagtttatactgtnagcaggcgtagcagcgtcggcccctctcccctctacgtttcgcggtagggaacagggttgaggatacgaaacgaacgngttaggctgcaccattctcgttcttcc

SEQ ID NO: 328557 - DNA, 594 bp, Homo sapiens
  misc_feature: GZ8MTXP01CGF8T.10.64.F09.1.454.CMB.2.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
tcagcatagtagtgcacgaccggtgctcgatttagcgcgtatacaaggggggaggaactgctcagtcaggacccagagggaaccatggaagccccagctcagcgtctcttcctcctgctactctggctcccagatataaccgcaggagaaattgtgttgacacagtctccagcccaccctgttctttgctccgagggggaaangccaccctctcctgcagggccagtcagagtgttagcaactaacttgtctaggtaaccaacagaaacctggccaggctcccaggctcctcatctatgatgcatccgacggagggccacgtggcactcccagcctaggttcagtggcaggtgggtctagggacngacttcacttcncaccanccaccgctacgacctagaagtntttgacttagtttactactgtacagcgaggtcgtaaggccaggcctccggcccccttctccccgtcgtaaccggtttcgggaccggggtaacgggaacccgtaaggggttcgggaacgacgtaaaccgaaacggttacgttgggttacgtcgtacggccaacccgtagttccgttcgttccgtttaacc

SEQ ID NO: 328558 - DNA, 567 bp, Homo sapiens
  misc_feature: GZ8MTXP01CVY03.10.64.F09.1.454.CMB.2.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (428)..(428): a, c, t, g, unknown or other
  misc_feature (428)..(428): n is a, c, g, or t
  modified_base (547)..(547): a, c, t, g, unknown or other
  misc_feature (547)..(547): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctccagatataaccgcggagaaattgtgttgacacagtctccagccacctgtctttgtctccgaggggaangcccacctctcctgcagggccagtcagtagtgttagcactaacttagtctaggtaccaaanagaaacctggcaggctccagctctcatctatgatgcatccgagacgggccagtcggcactcccagcctaggttcagttcggcgtaggtgggtactgggaacagtcttcactcctcaacactcgacccggctacgccctagagtactttgactagttttatactgtacaggnagtcggtacgcgacgtccgtccgtcccctcgtcccgtacgtcggttcggggacggaacggaacgtaagggtaggaacgtacgaacgtaaacgtcgttggttcgctaacgacctaacgtnttcgttacgttcttcgtaac

SEQ ID NO: 328559 - DNA, 546 bp, Homo sapiens
  misc_feature: GZ8MTXP01ELNA4.10.64.F09.1.454.CMB.2.raw
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (498)..(498): a, c, t, g, unknown or other
  misc_feature (498)..(498): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccgaggggaaancgccaccctctcctgcagggccagtcagagtgttagcaactaacttagtctaggtaccaaacagaaacctggccaggcncccaggcctcctcatctatgatgcatcccgacgagggccacgtggcactcccagccaggttcaggtcgcaggtgggtctgggaacagtcttcactctcaccatcgaccgacctagaccctgaagtatttgacttagtttatactgtcagacacgcggtagcacgccgtcgcccctcgtccctcgtaccggtttggacgggtagggaccaaagggtgganagttacgaaacgtattggttgctgctaacagtcttcgttcttctaacc

SEQ ID NO: 328560 - DNA, 630 bp, Homo sapiens
  misc_feature: GZ8MTXP01A7E0H.10.64.F09.1.454.CMB.2.raw
  modified_base (197)..(197): a, c, t, g, unknown or other
  misc_feature (197)..(197): n is a, c, g, or t
tcagcatagtagtgcacgaccggtgctcgatttagcgcgtatacaaggggggaggaactgctcagtcaggacccagagggaaccatggaagccccagctcagcgtctcttcctcctgctactctggctccagatataaccgcggagaaattgtgttgacacagtctccagccacctgtctttgtctccgaggggaancgccacctctcctgcagggccagtcagtagttgttagctaacttaacttagtctaggtaaccaacagaaacctggaccaggcctcccgaggcctcctacatctatgatcgcactccgacggacggccacgtggccactcccgagccgtaggttcaggtcggcgtaggtgggtcgtgggaacagtccttcaccttcctaccacctacgtcccgacccgggtcctaacgtaccctaggtaacttagttttcgacgtttagttttactaccgttgtacagtcgtacggtcggtaacggccgtacgtcccgttcccgtcccccttccgtacccgttacgtaccggtttccggggacgggtacgggaccgtaagggtcgagtaacgttacgaaacggtcgttggttcgcgtgcctaactgttcttacgttcttcgtcc

SEQ ID NO: 328561 - DNA, 506 bp, Homo sapiens
  misc_feature: GZ8MTXP02JW4CS.10.64.F09.1.454.CMB.2.raw
  modified_base (198)..(198): a, c, t, g, unknown or other
  misc_feature (198)..(198): n is a, c, g, or t
  modified_base (388)..(388): a, c, t, g, unknown or other
  misc_feature (388)..(388): n is a, c, g, or t
tcagcatagtagtgcacgaccggtgctcgatttagcgcgtatacaaggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagagtgttagcactaacttagtctggtaccaacagaaacctggccaggctcccaggctcctcatctatgatgcatccagaggccactggcatcccagccaggttcagtcggcagtgggtctggggacagcttcactctcacatcaccggcctagaccctgaagntttgctagtttattactgtcagcagcgtagcagctggcccctctccctctactttcgggcggtacgggaccaaggtcggagatacgaaacgactgtggctgcaccatctcgtctctac

SEQ ID NO: 328562 - DNA, 513 bp, Homo sapiens
  misc_feature: GZ8MTXP02FZYOF.10.64.F09.1.454.CMB.2.raw
  modified_base (199)..(199): a, c, t, g, unknown or other
  misc_feature (199)..(199): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaangccaccctctcctgcagggccagtcagagtgttagcactaacttagtctggtaccaacagaaacctggccaggctcccaggctcctcatctatgatgcatccacgaggccatggcatcccagccaggttcagtgcagtgggtctgggacagcttcactctcaccatccacccggcctagaccctgaagtatttgctagttttatactgtcagcagcgtagcagcctcggccccctcgtccctctacgtttcggcgggacgggaccaagggtcggagactacgaaacgacgtgtgctgcaccatctcgtctctac

SEQ ID NO: 328563 - DNA, 542 bp, Homo sapiens
  misc_feature: GZ8MTXP02JHKVS.10.64.F09.1.454.CMB.2.raw
  modified_base (200)..(200): a, c, t, g, unknown or other
  misc_feature (200)..(200): n is a, c, g, or t
  modified_base (353)..(353): a, c, t, g, unknown or other
  misc_feature (353)..(353): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccgaggggaaanagccaccctctcctgcagggccagtcagagtgttagcactaacttgtctggtaccaacagaacctggccaggctcccaggctcctcatctatgatgcatccacgaggccacgtggcatcccagccaggttcagtcgcaggtggtctggggacnggcttcactctcaccatcacccggcctagaccctgaacgtattttgctagtttactactgtcagcagcgtagcagcgtcggcccctctccctcgtacgtttcggacgggacgggacccgaagggtcggaagtacgacgaaaaccgtacgtaggtcggtcaaggacaccgtatcctcgttcctttacctc

SEQ ID NO: 328564 - DNA, 593 bp, Homo sapiens
  misc_feature: GZ8MTXP02HCMYU.10.64.F09.1.454.CMB.2.raw
  modified_base (199)..(199): a, c, t, g, unknown or other
  misc_feature (199)..(199): n is a, c, g, or t
  modified_base (421)..(421): a, c, t, g, unknown or other
  misc_feature (421)..(421): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccacctgtctttgtctccgaggggaaancgccaccctctcctgcagggccagtcagagtgttagctactaacttagtctaggtaaccaacaagaaacctggaccaggcctcccgaggcctcctcatctatgatgcactccgacggacggcctagtcggcactcccagcccgtaggttccaggtcggctagggtgggtctagggacaggtccttcactctccaccatccgaccgcctagaccctagaagtntttgacttagtttatacgtgtacagcagtcgtacgcacgtcgtaccgtcccctccgtccctacgtaccgtttcgggaaccgggtacgggaccgtaaggggtacggaacgtaacgtaacgaaaacggtacgttacggtcggactcgacacgtactcgttcttaccttcgtacc

SEQ ID NO: 328565 - DNA, 569 bp, Homo sapiens
  misc_feature: GZ8MTXP02J0GX8.10.64.F09.1.454.CMB.2.raw
  modified_base (198)..(198): a, c, t, g, unknown or other
  misc_feature (198)..(198): n is a, c, g, or t
  modified_base (354)..(354): a, c, t, g, unknown or other
  misc_feature (354)..(354): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtcttgtctccaggggaaangccaccctctcctgcagggccagtcagagtgttagcactaacttgtctggtaccaacagaaacctggccaggctcccaggctcctcatctatgatgcatccagaggccatggcatcccagccaggttcagtggcagtggctgggacagctcactcncaccatccgaccggcctagaccctgaacgtatttgctagtttacttactgtcagcagcgtagcagcttcgcccctcgtccctctaccgtttcgggaccgggtacggggacctaaggggtcggaacgtacgtaaccgaaaacggtaacgttcgggttacgggaccttaacgggaccctaaaccctacgttccgttacggtttccctttactacccg

SEQ ID NO: 328566 - DNA, 579 bp, Homo sapiens
  misc_feature: GZ8MTXP02G3AA5.10.64.F09.1.454.CMB.2.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccgagggaangccaccctctcctgcagggccagtcagagtgtagcactaattgtctggtaccaanagaacctggccaggctccagctccnatctatgatgcatccgacggacggccacgtggccactcccagccgtaggttcaggtcggctaggtcgggtcgtaggactagtccttcacgtcctaccacctactccgaacccggtcctaacgacccgtagtaacgttatttacgacgttacgtttacttacgtgtacacgtacaggtcgtacgcgagtcgtaccgcccctctccctcgtacgttcggacggtacggaccgtaggtcggaagacgtaacgaaacgtacgtacggtacgctcgaccaccgtacttcgtcgttactcttacccg

SEQ ID NO: 328567 - DNA, 611 bp, Homo sapiens
  misc_feature: GZ8MTXP02GHJBZ.10.64.F09.1.454.CMB.2.raw
  modified_base (201)..(201): a, c, t, g, unknown or other
  misc_feature (201)..(201): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgttctttgtctccgaggggaaancgccaccctctcctgcagggccagtcagagtgttagcaacttaacttagtctaggtaacccaaacaagaaaccctgggaccaggtcctcccaggcctcctcatctatgatgcatcccgacggaggcccagtcggacactccccgagccgaggttcagttcggctaggtggtctgggacagcttcactcacacatccaccggcctacgaccctagaacttattttgacttagttttattactgtacagacagcgtagctacgtcctacccggtcccccttccgttcccctccgttaccggtttccggggaccgggtaacggggaaccgtaaaggggtacggaaacgtaacgtaaccgaaaacggtactaggtcggactaacgactaacccttcttcgtcgttcttactacg

SEQ ID NO: 328568 - DNA, 651 bp, Homo sapiens
  misc_feature: GZ8MTXP02F5XWV.10.64.F09.1.454.CMB.2.raw
  modified_base (198)..(198): a, c, t, g, unknown or other
  misc_feature (198)..(198): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgctccaggggaaanagccaccctctcctgcagggccagtcagagtgttagcaactaacttagtctggtaaccaacagaaacctggaccaggcctcccgaggcctcctcatctatgatgcatccgaggacggccacgtggacactcccgagacccaggttcaggtcggacctagggttcggggtcgtaggggacctaggtaccttcacttcgtaccaaccctatcccgaacccgggtaccctaacggaccccgtagaaacgttagtttttacgacttaaggtttttaacttaaccgttggtacctagaccgtaacggtccgttaagcgtacgtccgttccggccccccttcgtccccttcgtaaccgtttcggggaccgggtaacggggacccaaggggtggacgtaaacgtaccgtaaaacgacgttggcgtacaacgactacacttccgtacgttccttacgtacc

SEQ ID NO: 328569 - DNA, 512 bp, Homo sapiens
  misc_feature: GZ8MTXP01D5X08.51.59.F04.1.454.CMB.2.raw
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
tcagcgatcgtatacacgaccggtgctcgatttagtacacacacttagggattggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaaccgatatgcttattggtacagcagaagccgggccaggcccctgtgttggtgatgtataaagacactgagaggcccctcaggggatccctgagcgattcctctggctccaggtcagggcaacggtcacattggccatcagtggagtccaggcaggaggacgagggctagactattattgtacaattcaaacagacaccattggtaacttatgtcttcgggaactgcgaccaaggttcacgtcngggttcagcccaaggccaacccacttgtcnctcc

SEQ ID NO: 328570 - DNA, 496 bp, Homo sapiens
  misc_feature: GZ8MTXP01D5Q8S.51.59.F04.1.454.CMB.2.raw
  modified_base (256)..(256): a, c, t, g, unknown or other
  misc_feature (256)..(256): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatangcttattggtaccagcagaagccgggccaggcccctgtgttggtgatgtataaagacactgagaggccctcagggatccctgagcgattctctggctccaggtcaggggacaacggtcacattggcatcagtgagtcagcagagacggaggctgactatatgtcaaatcaacagacaccaattggttacttattgtcttggaacttgcgaaccaaggtcacgtccngggtcngaaccccg

SEQ ID NO: 328571 - DNA, 508 bp, Homo sapiens
  misc_feature: GZ8MTXP01BLR45.51.59.F04.1.454.CMB.2.raw
  modified_base (256)..(256): a, c, t, g, unknown or other
  misc_feature (256)..(256): n is a, c, g, or t
  modified_base (349)..(349): a, c, t, g, unknown or other
  misc_feature (349)..(349): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgcaaaccgatangcttattggtaccagcagaagccggccaggcccctgtgttggtgatggtataaagacactgagaggccctccagggatcccgtgagcgattcnctggctcgagtcagggacacggtcacatggccatcagtgatccagcagagacggaggctagactatntgtcaatcaanagacacaattggttacttagttgtcttcggaacttgacgaaccaaagggtccaaccgtccgttcggggtcaacgaaccccg

SEQ ID NO: 328572 - DNA, 559 bp, Homo sapiens
  misc_feature: GZ8MTXP01AZEM3.51.59.F04.1.454.CMB.2.raw
tcagcgatcgtatacacgaccggtgctcgatttagtacacacacttagggattgggggtggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtaataaagacactgagaggccctcgaggggactccctgagcgattcctctggctccgaggtcagggcaacggtcacagttggccatcagtggagtccaggcagaggacgaggctggactattattgtacaatacaaacagaaccaccgtagttggtaacttatcgttcttacggaacttgccgaaccgtaaaggttccgtaaaccgtccgttgggttcacgaaccccgaagggccccaaaccccgcgttccgtaaccttaaccttcccg

SEQ ID NO: 328573 - DNA, 588 bp, Homo sapiens
  misc_feature: GZ8MTXP01AYCBU.51.59.F04.1.454.CMB.2.raw
  modified_base (459)..(459): a, c, t, g, unknown or other
  misc_feature (459)..(459): n is a, c, g, or t
tcagcgatcgtatacacgaccggtgctcgatttagtacacacacttagggattgggggtggggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaagccgggccaggcccctgtgttggtgatgtataaagacactgagaggcccctcgaggggactccccgtgacgcgattcctctggcctccgaggtcaggggcaaacgggtcacattggccatcagtgagtccaggcaggaggacgagctgactattattgacaatcaaacagaaccaccagtttaggtaacctttntcgttcttccggaaacttggaccgaaccgaacgggttcccgaaccggttcccgttgggggttccaaccggcccccgaaagggtcccccaaaaccccgtaccgttacggtaacccttaaccgtttccccg

SEQ ID NO: 328574 - DNA, 572 bp, Homo sapiens
  misc_feature: GZ8MTXP01A1K83.51.59.F04.1.454.CMB.2.raw
  modified_base (239)..(239): a, c, t, g, unknown or other
  misc_feature (239)..(239): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattgaccaaacgatatgcttattggtaccagcagaacgccggccacggcccctgtgttggtgatgtaataaagacactgagacggccctcgagggactcccgtgagcgtattctcgtcggctccgaggtcgaacggggaacaacgggtcaacgtacgttcgggacccagtccgaggttggacgtccgaggcgagacggacgggaggcgtgactattagtgtacaatacaacagacaacctaagttggttactttagttcgttcgttacgaacgttcgaccgaaccgtaggtaaccgtacccggtccgttacggggtccaacgaaccccg

SEQ ID NO: 328575 - DNA, 770 bp, Homo sapiens
  misc_feature: GZ8MTXP01EAZP9.51.59.F04.1.454.CMB.2.raw
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccaggcccctgtgttggtgatgtataaagacactgagaggcccctacgagggactcccgtgacgcgtatttccctcgtgggccttccgaggtaccgaaggggaaccaaacgggttcaacgtaatttcgggaccctaagtccgaagggttgggaacggttcccgaaggggaccaaagggaacggggaaccggaaggggtaccgttagggaaacctttaatttaaagtttcggtaaccgtaaaagttaccgaaaaacctaacggaaaccctaaacccctaagttttacggggtttaaacccttttaagttacgggtttacccgttttaaccgggggaaaacctttaacgggaacccggttaaacccggtaaaacgggttcccgtaaaccccgggtttcccggttacggggggttacccaaacccgggtaacccccgaaaaccggggtaacccccaaaacccccctaacgttaccggttaacccgttaacccttttcccccgg

SEQ ID NO: 328576 - DNA, 527 bp, Homo sapiens
  misc_feature: GZ8MTXP01CHPXN.51.59.F04.1.454.CMB.2.raw
  modified_base (484)..(484): a, c, t, g, unknown or other
  misc_feature (484)..(484): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcccatgagctgacacagccaccctcggtgtcagtgtcccccaggacagacggccaggatcacctgctctggagatgcattgccaaaccgatatgcttatggtaccagcagaagccgggccaggcccctgtgtggtgatgtataaagacactgagaggccctcgagggactccccgtgagcgattccctcgtggctccgaggtcaggggccaacgggtcacagttggccatcagtgagtccaggcagaggacgtagggctgactattattgtcaatacaacagacactattggtacttatgtcttcgggaactgacgacaaaggttcaaccgtcnggggttcacgcccaagggccccaacccacttcgtcaacgttcc

SEQ ID NO: 328577 - DNA, 626 bp, Homo sapiens
  misc_feature: GZ8MTXP01ED2DU.51.59.F04.1.454.CMB.2.raw
  modified_base (605)..(605): a, c, t, g, unknown or other
  misc_feature (605)..(605): n is a, c, g, or t
tcagcgatcgtatacacgaccggtgctcgatttagtacacacacttagggattgggggtgggtccaggaggcagaactctgggtgtctcaccatgtcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgtcttattggtaccagcagaagccgggccacggcccctgtgttggtgatgtaataaagacactgaagacggccccgtcgaagggtactcccgtagacgcgtatttccctcgtgggcctccgtaggtaccgaagggaaccgtaaacgggtcaactagttcgggacccagtacgaggttgggacgtacccgaggacgaggaacgggacgaaggcgtagacttaattagttgtacaattacgaaacacgaacacctagtttcggttaactttagtgttacgtttacggaaacgttgaccgaaccgtaaaggttccgaccggttccgttgggttcccacgaaccccgaaacggcccaaaaccccncgttcgtccgaacgtttcccg

SEQ ID NO: 328578 - DNA, 622 bp, Homo sapiens
  misc_feature: GZ8MTXP01EBEPC.51.59.F04.1.454.CMB.2.raw
  modified_base (418)..(418): a, c, t, g, unknown or other
  misc_feature (418)..(418): n is a, c, g, or t
tcagcgatcgtatacacgaccggtgctcgatttagtacacacacttagggattgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaaccgatatgtcttatggtaccagcagaacgccggccacggccctgtgtggtgatagtaataaagacacgtgaacggacggcccctacgaaggggacttccccgtagacggcgtactttcccgtcgtggcctaccgaggtacgaacgggaactaacggtcactagttcggcatcgagtgganccgaggcaggaggacgtagctagacttattattagtacaataccaaagacgaacctacctagtttaggtaactttagtcgttaccgttacgggaaacttcgggaacccgaacccggtaaaggttcccgtaaacccggtcgttacggggccaacggaaccccgaaacggaaccccaaccccgtattcgtaaccttaacttccccg

SEQ ID NO: 328579 - DNA, 541 bp, Homo sapiens
  misc_feature: GZ8MTXP01BBCTA.51.59.F04.1.454.CMB.2.raw
  modified_base (238)..(238): a, c, t, g, unknown or other
  misc_feature (238)..(238): n is a, c, g, or t
  modified_base (531)..(531): a, c, t, g, unknown or other
  misc_feature (531)..(531): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagcccgggccacggccccctgtcgttggtgatgtataaagacactgagaggccctccgagggatcccgtgagcgattctctggctccgaggtcgagggacaacggtcacagttcggaccagtcaggtggacgtccgagggcaggaggacggagggctaggactatttagttcgtactaaactcaaacagaacaccaagtttgttacttattgtacgttggacttgccgaactaggtccaccgtcgttcgggtcncggaaccccg

SEQ ID NO: 328580 - DNA, 538 bp, Homo sapiens
  misc_feature: GZ8MTXP01C004Q.51.59.F04.1.454.CMB.2.raw
  modified_base (238)..(238): a, c, t, g, unknown or other
  misc_feature (238)..(238): n is a, c, g, or t
  modified_base (416)..(416): a, c, t, g, unknown or other
  misc_feature (416)..(416): n is a, c, g, or t
tcagcgatcgtatacacgaccggtgctcgatttagtacacacacttagggattggggtgggtccaggagggcagaactctgggtgtctcaccatgtcctggatccctctacttctcccctcctcactctctgcacaggctctgaggcctcctatgagctgacacagccacccctcggtgtcagtgtccccaggacagacggccaggatcacctgctctggagatgcattgccaaacgntatgcttatggtacagcagaagccgggccaggcccctgtgtggtgatgtataaagacactgagaggccctcaggggatccctgagcgattcctctggctccaggtcagggcaacggtcacattcggcatcagtgagtccaggcaggagacgagctgactattattgtacgaatcaaanagacaccagttcggtaacttatgtcttcggaactgtcgactaaacgggttctaaacccggtcttacgggggttcacgaaccccaaacgggcccaaaccccgacttcggtccaacgtttcccg

SEQ ID NO: 328581 - DNA, 642 bp, Homo sapiens
  misc_feature: GZ8MTXP01C1PRR.51.59.F04.1.454.CMB.2.raw
  modified_base (287)..(287): a, c, t, g, unknown or other
  misc_feature (287)..(287): n is a, c, g, or t
  modified_base (616)..(616): a, c, t, g, unknown or other
  misc_feature (616)..(616): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggccctgtgtggtnatgtataaagacactgagacggccctacgagggactcccgtaggacgcgtaactttccccgtcgtgggccttccgagggtaccaaggggaaccaaacgggtcaaccgtagttcgggacccagtccgaaggtggagtccgaggcgaaggagggtacggaggctgaacttattattcgactaaactcaaaacacgaacaaccgtagtttaggttaaacctttagtacggttccttacgggaaactttcggaccggaaaccgtaaacgggttcctaacccgggttccgttaggggttccaccggaaccccgaaacggccctaaaacccccgngttccgttaaccgaacccgtttcccg

SEQ ID NO: 328582 - DNA, 538 bp, Homo sapiens
  misc_feature: GZ8MTXP01BNIC7.51.59.F04.1.454.CMB.2.raw
  modified_base (423)..(423): a, c, t, g, unknown or other
  misc_feature (423)..(423): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccaggccccctgtcgttggtgatgtaataaagacactgagaggccctcgagggatcccgtgagcgattctctggctccgaggtcgagggacaacggtcacatggccatcagtggagtccgaggcagaggacgggagntgactagttattgtacaatcaaacagacaccaattaggttacttagttgtcttacggaacttgacgtaaccgtaaaggtcctaacccggtcccgttaggggtccaacgaaccccg

SEQ ID NO: 328583 - DNA, 572 bp, Homo sapiens
  misc_feature: GZ8MTXP01C1GJG.51.59.F04.1.454.CMB.2.raw
  modified_base (238)..(238): a, c, t, g, unknown or other
  misc_feature (238)..(238): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacgccaggatcacctgctctgganatgcattcgaccaaacgatatgcttagttggtaccagcagaagcccgggccacggcccctgtacgttggtagatgtaataaagactactgacgacgccctacgagggactcccgtgacgacgtattcctcgtgggccttacgaggtacgagggacaacggtcaactagtcggccatcagtggagccgaggcaggacggacgggtaagcgtagacttaattattgtactaatcaaacacgaacacctaagtttcggttactttagttcgttacttcgggaaacttgaccgaacctaaaggtccaaccggtcgttacgggtaacaacgtaaccccg

SEQ ID NO: 328584 - DNA, 548 bp, Homo sapiens
  misc_feature: GZ8MTXP01D2XHT.51.59.F04.1.454.CMB.2.raw
  modified_base (242)..(242): a, c, t, g, unknown or other
  misc_feature (242)..(242): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctgganatgcattgaccaaaccgatatgcttattggtaccagcagaagccgggccacggcccctgtgttggtgatgtaataaagacactgagaggccctcgagggactcccgtgacgcgtattcgtcgtgggcctccgagggtcgaggggaacaacgggtcacagttcggccagtcgagtggacgtccgaggcaagaggtacggaggctagacttattattgactaatcaaacagaccaactaattggttacttattcgtcttcggaacttgaccgtaacaaggtcaccggtcgttgggtcaacgaaccccg

SEQ ID NO: 328585 - DNA, 548 bp, Homo sapiens
  misc_feature: GZ8MTXP01BMTVB.51.59.F04.1.454.CMB.2.raw
  modified_base (196)..(196): a, c, t, g, unknown or other
  misc_feature (196)..(196): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctctggagatgcattgaccaaaccgatatgcttattggtaccagcagagcccgggccacggcccctgtgttggtgatgtataaagacactgagagccctcgagggactcccgtagcgacgtattctcgtggcctccgaggtcgagggaccaacggtcacgtagttcggccagtacgaggttggacgtccgaggcaggaggacgggaggctagacttattatgtacaatacaacagacacctaattggttacttattcgtacgttcgaacgttcgacgaaccacggtccaccgtcgttcgggtccgaacgaaccccg

SEQ ID NO: 328586 - DNA, 594 bp, Homo sapiens
  misc_feature: GZ8MTXP01AQTF8.51.59.F04.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (367)..(367): a, c, t, g, unknown or other
  misc_feature (367)..(367): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacngcagagcggcagccctgtgtggnatgtataaagacactggagacggccctgagggtactcccgtgacgcggtattccgtcgtggcctccgaggtacagggaacaacgggtcaancgttggccatcgagtggacgtcgaggcgagacgggacgaggtctagactagttagttcgtacgtaactacgaacaacgaacctaccgtagttaggttacttattgttacgttcggaaactcggaccgaaccgtaacggttccgtaacccggtcgttcggggccaaccgggccccgaaaccggaacccctaaaccccgtcggttaccgttaaccaacccgtttccccg

SEQ ID NO: 328587 - DNA, 541 bp, Homo sapiens
  misc_feature: GZ8MTXP01D20QH.51.59.F04.1.454.CMB.2.raw
  modified_base (241)..(241): a, c, t, g, unknown or other
  misc_feature (241)..(241): n is a, c, g, or t
  modified_base (451)..(451): a, c, t, g, unknown or other
  misc_feature (451)..(451): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggataacctgctctgganatgcattgccaaaccgatatgcttatggtaccagcagaagccgggccaggcccctgtgttggtgatgtataaagacactgagaggccctgacgggactccgtgagcgaattctcgtggctccgaggtcgaggggacaacggtcactattggccatcagtggatccgagcaggaggacgaggggctggacttagttattgacaatacaaanacgacacctagtttcggtactttatgttcgttcggaacttgccgacgaaggtccaaccggttcctgggttaccaacgccccgaaacccgg

SEQ ID NO: 328588 - DNA, 541 bp, Homo sapiens
  misc_feature: GZ8MTXP01DS0U6.51.59.F04.1.454.CMB.2.raw
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (441)..(441): a, c, t, g, unknown or other
  misc_feature (441)..(441): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccaggcccctgtgttggtgatgtataaagacatgagaggccctcagggatccctgagcgattcnctggctccaggtcagggacaacggtnacagttggccatcagtgagtccgagcagaggacggaggctgacgtattagttgtacaatcaaanacgaacaacctaattggttacttaagttgttacgttcggaaaccgttgaccgtaaccgaaacggtccaacccgtccgttcggggtccaaccggaaccccg

SEQ ID NO: 328589 - DNA, 633 bp, Homo sapiens
  misc_feature: GZ8MTXP01DQTC8.51.59.F04.1.454.CMB.2.raw
tcagcgatcgtatacacgaccggtgctcgatttagtacacacacttagggattgggggtgggtccaggaggcagaactctgggtgtctcaccatggcctggatccctctacttcctccccctcctcactctctgcacaggctctgaggcctcccatgagctgacacagccaccctcggtgtcagtcgtccccaggacagacggccaggatcactgctctggagatgcattgaccaaacgatatgtcttagttggtaccagcaagaacgccgggccacggcccctggtgttggtgatgtaaataaagacacgtagaggacggccctagagggactcccgtgacgtcgtatttcctcgtggtcctccgaggtacgagggaacgaacgggtctaacgacgttcgggacccagtacgaggttggacgtaccgaggacgaggagggacgaggctagactattatgtacaatacaaactagactaccgtagtttaggtaacttagtcgttacgttacggaacttaacgacggaaccgtaacgggttcctaaccggttccgttacgggggttacaacccgggaaccccgaaacgggccccctaaaccccgcgttaccgtaacccttaacccgtttccccg

SEQ ID NO: 328590 - DNA, 599 bp, Homo sapiens
  misc_feature: GZ8MTXP01D0J3W.51.59.F04.1.454.CMB.2.raw
  modified_base (578)..(578): a, c, t, g, unknown or other
  misc_feature (578)..(578): n is a, c, g, or t
  modified_base (589)..(589): a, c, t, g, unknown or other
  misc_feature (589)..(589): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctcgtggagatgcattgaccaaaccgatatgcttattggtaccagcagaagccgggccaggcccctgtgttggtgatgtaataaagacactgagacggccctcgagggactcccgtgacgcgtattccctctcggctcccgagggtaccgagggaaccgaacggtcactagttcggaccagtccgaggttggagtccgagggcgaggagggacgaggctagactattattgtacgaaattacaaactacgaactacctagtttaggttaccttagttcgttcttacggaacttgaccgttaaccgtaacggttccgtaccggttccgttcgggttcaccggaacccgaacggcccaaaccccngttcgtaaccnctttaacccg

SEQ ID NO: 328591 - DNA, 589 bp, Homo sapiens
  misc_feature: GZ8MTXP01CFRZ8.51.59.F04.1.454.CMB.2.raw
  modified_base (239)..(239): a, c, t, g, unknown or other
  misc_feature (239)..(239): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacgccaggatcacctgctctgganatgcattgaccaaaccgatatgcttagttcggtaccagcagaacggccgggccgacggcccctgtcgttggtgatgtaataaagacactgagacggcctcgagggctcccgtgagcgtattctctcggctcgaggtcgagggacaacggtcacagttcggaccatacgaggtggacgtccgaggcgaaggagggaaccgggagggtactaggacttaagtttagttgtaccaaatacaaacgtacgaacaccctaagtttacggttactttagttgttaccgttacggaacgttcgaccgtaaccgtaacggtccaccggttcccgttcgggtaaccgaacgaaccccgg

SEQ ID NO: 328592 - DNA, 648 bp, Homo sapiens
  misc_feature: GZ8MTXP01DT8IF.51.59.F04.1.454.CMB.2.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctcccctctcactctctgcacaggctctgaggcctcctatgagctgacacagcccacccgtcggtgtcagtcgtccccaggacagacggccaggatcacctgctctgganatgcattgaccaaacgatangcttattggtaccagcagaacgccggcacggcccctggtgttggtgatgtaataaagacactgagacggccctacgagggtactcccgtgaacgtcgtactttcgtcgtacgggtcctaccgaggtacgaacggggtaccaacgggttcaacgtagttcgggacctaacgttaccgaggttggacggtacccgagggaccgtaaagggacgggaacggggtacggggtaccgttaggtaaacctttaagtttacgtttacggtaaacctaaagttaccaaacgtacgaacctaacccgtaagtttacggttactttagttcgtcgtttacggacgttcgaccgtaaccgaacggtctaccggtccgttgggtccaacggtaaccccg

SEQ ID NO: 328593 - DNA, 601 bp, Homo sapiens
  misc_feature: GZ8MTXP01AIUZT.51.59.F04.1.454.CMB.2.raw
  modified_base (591)..(591): a, c, t, g, unknown or other
  misc_feature (591)..(591): n is a, c, g, or t
tcagcgatcgtatacacgaccggtgctcgatttagtacacacacttagggattgggggtggggtccaggaggcagaactctgggtgtctcaccatgtcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtacagcagagccggcaggccctgtgtggtgatgtataaagacactgagacggccctcgagggactcccgtgacgcgatttcctctgggcctccgaggtaccgagggaacaacgggtcacgagtttgggccatcgagtggacgtccgaggcgaggaggacgaggctagactattattgacgtaatacaaacacgaaccaccgtagttacggttaactttagttcgttaccgttacgggaaacttcggaccgaaccgtaaacgggttcccgtaacccggttccgttacggggttccacggaacccccgaacggaacccccaaccccgtacttcggtaacccnccgtttcccg

SEQ ID NO: 328594 - DNA, 673 bp, Homo sapiens
  misc_feature: GZ8MTXP01BT2L6.51.59.F04.1.454.CMB.2.raw
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattgacccaaaccgatatgtcttattcggtaccagcagaacgccgggcacggccctgtgtggtgtatgtaataaagacacgtggaggacgccctagagggtactcccgtgagtcgtatttcccgtcgtcggctccgaggtaccgaacgggaacgaacgggtacacgtagttcggacctagtccgagggtggtacgtacggacggcgaagggacgggaacggacggtacgtaaggttaacgttaatttaacgttcgtaacctaaagttaccaaacaacggtaacctaacctagttttaccggtaaactttacgttcgttacgttaaccgggtaatcggaccgttaaccgtaaacggttcccgaacccggttcggttcggttccaacccggtaacccaaaccgggccccaaccccgtagttacccgtaaccgttaaccctttcccgg

SEQ ID NO: 328595 - DNA, 667 bp, Homo sapiens
  misc_feature: GZ8MTXP01CXBAK.51.59.F04.1.454.CMB.2.raw
  modified_base (238)..(238): a, c, t, g, unknown or other
  misc_feature (238)..(238): n is a, c, g, or t
tcagcgatcgtatacacgaccggtgctcgatttagtacacacacttagggattggggggtgggtccaggaggcagaactctgggtgtctcaccatgtcctggatccctctacttctcccctcctcactctctgcacaggctctgaggcctcctatgagctgacacagccaccctcggtgtcagtgtccccaggacagacggccaggatcactgctctggagatgcattgaccaaacgntatgcttatggtacagcagaagcggcagccctgtgtggtgatgtataaagacactgagaggccctgagggactccctgagcgtattccctcgtggctccgaggtaacgagggaacaaacgggtcaactagttcgggaccctaatcgaagtcggaacgtccgagggacaaggaggtacgaggctagactattatacgtacaaacttacaaacaacggaactaaccctaagtttacgggttaaacctttagttacggttaccgtttacgggtaaacccgttaagggaacccggttaaaccgtaaacgggggttcccttaaacccgggttcccgttaacgggggttcccaaaccgggtaacccccggaaaaccggggtcccccaaaaacccccctcgtttaccggttaacccgttaaacccggttttccccg

SEQ ID NO: 328596 - DNA, 704 bp, Homo sapiens
  misc_feature: GZ8MTXP01B5BUM.51.59.F04.1.454.CMB.2.raw
  modified_base (295)..(295): a, c, t, g, unknown or other
  misc_feature (295)..(295): n is a, c, g, or t
tcagcgatcgtatacacgaccggtgctcgatttagtacacacacttagggattgggggtgggtccaggaggcagaactctgggtgtctcaccatgtcctggatccctctacttcctccccctcctcactctctgcacaggctctgaggcctcctatgagctgacacagccaccctcggtgtcagtcgtccccaggacagacggccgaggatcacctgctcgtggagatgctattcgacccaaaccgatatgtcttattggtaccagcagaacgccggccacggccctgtgttggngatgtaataaagcatgagacgccctgaggactcccgtgagtcgtatttcccgtcgtggcctccgaggtaaccgaacggggaaccgaaaccgggtcaacgtacgttcggaccctagtcgagggttggacgtcgaggacgaagggaacggacgggacggtacgtagtaacttagtttagtttacggtaacgtaaacgttaacaaaccgtaacggtaacctaaacccgttgtttaacgggtttaactttaagttcggtttaccgttaaccgggtaacttaacgggacccgttaaaccggtaacgggttacccgtaacccggttccggttacgggggttccaaccccgggtaacccgaaaccgggtaaccccctaaacccctacgttccgtaacccttaacccgtttccccgg

SEQ ID NO: 328597 - DNA, 624 bp, Homo sapiens
  misc_feature: GZ8MTXP01DADR3.51.59.F04.1.454.CMB.2.raw
  modified_base (240)..(240): a, c, t, g, unknown or other
  misc_feature (240)..(240): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctccccctctcactctctgcacaggctctgaggcctctatgagctgacacagcccaccctcggtgtcagtcgtccccaggacagacggccagatcacctgctcgtgganatgctattcgaccaaacgatatgtcttatcgtacagcagacgccggcacggccctgtgttggtgatagtaataaagacactagacgacggccctccgacgggtactcccgtgacgacgtacttctcgtcggcctacgacgggtacgaacgggacctacggtacaactagttcggactagtacgaggtgacgtacgaggcgaggtaagggacgggaggtcgtagtaacttaagtttagttacgtactaaacgactaaacgaagtaacctaaccttaagttacgtttaacgttacttacggttacgttaccggaacgttcggacccgtaaccgtaaacggtcccgtaacccggtccgttaccgggtccgaacccggtaacccccgg

SEQ ID NO: 328598 - DNA, 593 bp, Homo sapiens
  misc_feature: GZ8MTXP01A4C8U.51.59.F04.1.454.CMB.2.raw
tcagcgatcgtatacacgaccggtgctcgatttagtacacacacttagggattgggggggagcctagctgtgctgtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggcccctgtgttggtgatgtaataaagacactgagaggcctcgagggactcccgtgagcgattctcgtggctccgaggtcgagggacaacggtcactagttggacctatacgaggtggacgtcccgaggccaagggaacgggacgggaagggtcgtaggtaacttaattagttgtactaaactacaaaccagaaccaacctaagtttaggttacttaaagttcgtacgtttaacggaaacttggaccgtaacccgtaaagggtcctaacccggttcccgttacgggttccgaaccggtaacccccgg

SEQ ID NO: 328599 - DNA, 681 bp, Homo sapiens
  misc_feature: GZ8MTXP01DQC2Z.51.59.F04.1.454.CMB.2.raw
  modified_base (245)..(245): a, c, t, g, unknown or other
  misc_feature (245)..(245): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctccccctctcactctctgcacaggctctgaggcctcctatgagctgacacacgcccacccgtggtgtcagtcgtccccaggacagacggccaggactcacctgctcgtgganatgacattcgacccaaaccgatatgtacttagttcggtaaccgagcaaggaacggccccggaccgacggtccccttgttggttcggtgattagtaataaagacactgacgacggcccctagacggtactcccgtagacgtcgtacttcgtcgtcggcctcgaggtcgagggtaccaacggtcagtagttcgactagtacgaggtgacgtccgagacgaggtacgggaacggtaggtaccgtagtaaccttagttagttacgtaactaaacgtaccgaaacgtaaccgaaccgtaaccgttaaagtttacggtttaaacgtttacgttaacggttccgtttaaaccgggttacgttacggttaaccccgaaccggttaaaccggtcccgtaaccggttcccggttacggggttaaccgaaccccggtaaacccccgg

SEQ ID NO: 328600 - DNA, 591 bp, Homo sapiens
  misc_feature: GZ8MTXP01DODDB.51.59.F04.1.454.CMB.2.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
tcagcgatcgtatacacgaccggtgctcgatttagtacacacacttagggagttggggggggagcctagctgtgctgtgggtccaggaggcagaactctgggtgtctcaccatggcctggatccctctacttcctcccctctcactctctgcacaggctctgaggcctcctatgagctgacacagccaccctggtgtcagtcgtccccaggacagacgccaggactcactgctcgtgganatgactattcgaccaaacgatatgtacttagttcggtaccagcaaggaacggcccggccacggtcccctggtgttggtanatgtaataaagacagtgagcgtccctcgagggtactcccgtgacgtcgtattcgtcgtcgcctcgaggtcgacgggaacctacggtcaactagtcggaccagtacgaggtggacnccgagacgaaggacggtaggggacggngttacgtaacgttattagtcgtaacaaatcgaaanacgaactacttaagttaggttactttattcgttacgttcggaacgttcgaccgaacgtaagtccgaccgtcggttacggtaacgccgaaccccg

SEQ ID NO: 328601 - DNA, 586 bp, Homo sapiens
  misc_feature: GZ8MTXP01CNE4A.51.59.F04.1.454.CMB.2.raw
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgtcttattggtacagcagaagccggcacggccctgtgttggtgatgtataaagacacgtagagacggccctcgaggggactcccgtgagcgtattcctcgtggcctcgaggtcgaagggccaacgggtcacgtagttcgggacctagtcgagttggacgtccgaggcgaggacggacgaggctaggacttattagttagtacaatacaaacagaacctaccgtagtttacggtaacttagtcgtcttacggaacttcggacgacgtacgttccgtaaccgtcgttcgggttcaccggcccaacggccccaaacccctcgttaccgtccaacgtttccccg

SEQ ID NO: 328602 - DNA, 614 bp, Homo sapiens
  misc_feature: GZ8MTXP01DQ5DO.51.59.F04.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
tcagcgatcgtatacacgaccggtgctcgatttagtacacacacttagggagttggggggggagcctagctgtgctgtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacgcagatcactgctntgganattcattgaccaaacgatatgcttatggtaccagcgagaacgccggccacggcccctgtgttggtgatgtaataaagacactgagacggccctcgacgggctccgtgacgcgtaattctcgtcggcctccgaggtcgaacggggacaaacgggtcaacgtattcggaccattcgagtcggacgtccgaggcgaagagggtacgaggggctagtaacttattagttgtacaaatacaaactagaacctaaccgtagtttaacggttaacttagttcgttacgttacgggtaacttcggaccgttaacccggtaaaggttcccgtaaacccggttccggtacgggttaccgtaaccggaaccccgtaaaaccccggg

SEQ ID NO: 328603 - DNA, 574 bp, Homo sapiens
  misc_feature: GZ8MTXP01A9TP4.51.59.F04.1.454.CMB.2.raw
  modified_base (195)..(195): a, c, t, g, unknown or other
  misc_feature (195)..(195): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctccccctctcactctctgcacaggctctgaggcctcctatgagctgacacagccaccctggtntcagtcgtccccaggacagacggccaggatcacctgctcgtgganatgcattcgaccaaacgatangcttattggaccagcaagacgccggccacgccctgtgtgngatatanaagacacgtgacggacggccctacggacgggtactcccgtgacgtctactttcncgtcggtccttaccgaggtcgagggacaacggtcaacgtgttcggacctagtacgaggttggacgtccgaaggcgaagacgggacggtaggggcttaggactttagttagtcgtaacaactacaaacgtacgaacctcggtaattagttactagttctacggtcgacgttgacgtaaccgtagtcctaccgtcgacggtcaaccgtaacccg

SEQ ID NO: 328604 - DNA, 499 bp, Homo sapiens
  misc_feature: GZ8MTXP02HWB9G.51.59.F04.1.454.CMB.2.raw
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactccctgagcgattctctggctccgaggtcagggacacggtcacattggccatcagtggagtcaggcagaggacgaggctggactattatgtacaatcaacagacacattggtacttatgttcttcggaactgacgaacgaaggtcaccgtctcggtcacgacccg

SEQ ID NO: 328605 - DNA, 485 bp, Homo sapiens
  misc_feature: GZ8MTXP02IR4BR.51.59.F04.1.454.CMB.2.raw
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctntggctccaggtcagggacaacgtnacatgcatcagtgagtcagcagagacgaggctgactatatgcaatcaacagacactatgtacttatagtcttcggaactgacgaacgaaggtcaccggtctcggtcagcccg

SEQ ID NO: 328606 - DNA, 513 bp, Homo sapiens
  misc_feature: GZ8MTXP02GU29I.51.59.F04.1.454.CMB.2.raw
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganattcattgccaaaccgatatgcttatggtaccagcagaagccggccaggcccctgtgttggtgatgtataaagacactgagaggccctnacggggatccctgagcgattctctggctccaggtcagggacaacgggtcacattggccatcagtggagtccgaggcagaggacgaggctgactagttattgtacaatcaaacagacaccattacggtactttatgtcttacggaactcgcgtaccaaggtcaccgtcgtgggtcacgcccaaaccgg

SEQ ID NO: 328607 - DNA, 504 bp, Homo sapiens
  misc_feature: GZ8MTXP02JYFB6.51.59.F04.1.454.CMB.2.raw
  modified_base (302)..(302): a, c, t, g, unknown or other
  misc_feature (302)..(302): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggngatgtataaagacactgagaggcctcgagggatccctgagcgattctctggctccaggtcgagggacaacgggtcacagttcggccatcagtggagtccaggcagaggacgaggctgactatattgtacatcaananacacctagttaggtacttatgttcttacgaactgacgaacgagtcaccgtctcggtcacgacccg

SEQ ID NO: 328608 - DNA, 580 bp, Homo sapiens
  misc_feature: GZ8MTXP02HC5O6.51.59.F04.1.454.CMB.2.raw
  modified_base (239)..(239): a, c, t, g, unknown or other
  misc_feature (239)..(239): n is a, c, g, or t
  modified_base (433)..(433): a, c, t, g, unknown or other
  misc_feature (433)..(433): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggcccctgtgtggtgatgtaataaagacactgagacggccctacgagggactcccgtgacgcgtattcctcgtcggctccgaggtcgaagggacaaacgggtcaacgtagttcggaccatcgagtggacgtccgaggcagaggacgaggctagactattatgtanaatcaacagaacacgtagttacgtacttagtgttactacggaaacttcgaccgtaacctaaacggtccaacccggttccgtacggggtaccaccggaaccccgaaacggacccccaaaccccgtactccgtaccctaactttccccg

SEQ ID NO: 328609 - DNA, 501 bp, Homo sapiens
  misc_feature: GZ8MTXP02FOPAL.51.59.F04.1.454.CMB.2.raw
  modified_base (337)..(337): a, c, t, g, unknown or other
  misc_feature (337)..(337): n is a, c, g, or t
  modified_base (410)..(410): a, c, t, g, unknown or other
  misc_feature (410)..(410): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggcctcagggatcccngagcgattctctggctccgaggtcaggggacaacggtcacatggccatcagtggagtccagcagagacgaggntgactattacttgtcaatcaacagacaccattggtacttaatgtcttcggaactgccgaactaacggtcaccgtcctgggtcacgaccccg

SEQ ID NO: 328610 - DNA, 499 bp, Homo sapiens
  misc_feature: GZ8MTXP02IB5QE.51.59.F04.1.454.CMB.2.raw
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggcctcagggatccctgagcgattctctggctccaggtcagggacaacggtnacattggccatcagtggagtccagcagaggacgaggctgactattatgtacaatcaanagacacctattggtacttatgtacttcggaactgacgaaccgaggtcaccgtcncgggtcacgacccg

SEQ ID NO: 328611 - DNA, 477 bp, Homo sapiens
  misc_feature: GZ8MTXP02H5TSE.51.59.F04.1.454.CMB.2.raw
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (449)..(449): a, c, t, g, unknown or other
  misc_feature (449)..(449): n is a, c, g, or t
tcagcgatcgtatacacgaccggtgctcgatttagtacacacacttagggattggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggcaggcccctgtgtggtgatgtataaagcactgagaggccctnagggatccctgagcgtattcctctggctccgaggtcagggcaacggtcacattggccatcagtgagtcagcagagacgagctagactattatgtacatcaangacacattgtactatgtctcgaactgcgacagcacgtcnggtcagccagaccacccatcgtcactcg

SEQ ID NO: 328612 - DNA, 496 bp, Homo sapiens
  misc_feature: GZ8MTXP02G3T95.51.59.F04.1.454.CMB.2.raw
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggcctcagggatccctgagcgattcnctggctccaggtcagggacaaacgtcacattggccatcagtgagtccagcagagacgaggcngactatattgtcaaatcaaacagacaccattaggtacttatgtcttacggaactgcgaaccaaggtccaccgtctcgggtcacgacccg

SEQ ID NO: 328613 - DNA, 492 bp, Homo sapiens
  misc_feature: GZ8MTXP02HVFP8.51.59.F04.1.454.CMB.2.raw
  modified_base (299)..(299): a, c, t, g, unknown or other
  misc_feature (299)..(299): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaaccgatatgcttatggtaccagcagaagccggccaggcccctgtgttggngatgtataaagacactgagaggccctcgagggactccctgagccgattctctggctccaggtcagggacacgtcanatggccatcagtgagtccagcagnggacgaggctgactattatgtacaatcaaacagacaccattggtacttatgtctacgaactgcaacgaaggtcacgtcgtcggtcacgacccg

SEQ ID NO: 328614 - DNA, 509 bp, Homo sapiens
  misc_feature: GZ8MTXP02F2K4O.51.59.F04.1.454.CMB.2.raw
  modified_base (348)..(348): a, c, t, g, unknown or other
  misc_feature (348)..(348): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctcccctctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgtggtgatgtataaagcactgagaggccctcgaggggactcccgtgagcgtattcnctggcctccgaggtcagggacaacggtcacagttcggaccatcgaggtggacgtccaggcaggaggacgaggctgacttattagtgtacaatcaanagacactattgtaacttntgtactacgaactgacgaacgaaggtcacgtcgtcggtcacgacccg

SEQ ID NO: 328615 - DNA, 502 bp, Homo sapiens
  misc_feature: GZ8MTXP02JZ7J4.51.59.F04.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (469)..(469): a, c, t, g, unknown or other
  misc_feature (469)..(469): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgttggtgatgtataaagacactgagaggccctnagggatccctgagcgattcctctggctccaggtcagggcaacgggtcacattgccatcagtggagtcccgaggcaggaggacgaggctgactattattgtacatcaacagacacattggtacttatgtcttcggaactgacgacaacggtcaccgtcngggtcagcccaaggcccaacccactcgcactcg

SEQ ID NO: 328616 - DNA, 495 bp, Homo sapiens
  misc_feature: GZ8MTXP02G5HO5.51.59.F04.1.454.CMB.2.raw
  modified_base (414)..(414): a, c, t, g, unknown or other
  misc_feature (414)..(414): n is a, c, g, or t
  modified_base (482)..(482): a, c, t, g, unknown or other
  misc_feature (482)..(482): n is a, c, g, or t
tcagcgatcgtatacacgaccggtgctcgatttagtacacacacttagggattgggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccagggcccctggtgttggtgatgtataaagacactgagaggcctccagggatccctgagcgattctctgggcctcaggtcagggacaacggtcacattggccatcagtgagtccaggcaggagacgaggcngactattactgtacaatcaacagacaccaattggtactatgtctcggactgagaacgaggtcacgtcncggtcacgacccg

SEQ ID NO: 328617 - DNA, 517 bp, Homo sapiens
  misc_feature: GZ8MTXP02IWINH.51.59.F04.1.454.CMB.2.raw
  modified_base (384)..(384): a, c, t, g, unknown or other
  misc_feature (384)..(384): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtcccccaggacagacggccaggatcacctgctctggagatgcattgccaaaccgatatgcttattggtaccagcagaagccggccaggcccctgtcgttggtgatgtaataaagacactgagaggccctcgagggactccctgagcgattctctggcctccgaggtcgagggacaacggtnacatggccatcagtgagtccagcagaggacgaggctagactattatgtacaatacaacagacacctattcggtattatgttacttacgaactcgacgaacgaacggtctaccgtctacgggtcacgaaccccg

SEQ ID NO: 328618 - DNA, 528 bp, Homo sapiens
  misc_feature: GZ8MTXP02JX7RI.51.59.F04.1.454.CMB.2.raw
tcagcgatcgtatacacgaccggtgctcgatttagtacacacacttagggattgggggtgggtccaggaggcagaactctgggtgtctcaccatgtcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagacggccctcgagggactcccgtgagcgtattccctctggctccgaggtcagggacaacgggtcactagttcggccatcagtggagtccgaggcaggaggacgaggctgactattatgtacaatcaacagaccactattggtacttatgttcttacggaactcgacgaccgacggtcaccgtcgtcggtcacgcccgaacggcccaacccactcgtacacttccg

SEQ ID NO: 328619 - DNA, 493 bp, Homo sapiens
  misc_feature: GZ8MTXP02FLA7V.51.59.F04.1.454.CMB.2.raw
tcagcgatcgtatacacgaccggtgctcgatttagtacacacacttagggattggggtagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgctatggtaccagcagaagccgggccaggccccctgtgttggtgatgtataaagacactgagaggccctccaggggatccctgagcgattctctggctccagtcagggacaacggtcacattggccatcagtgagtccagcagaggacgagctgactattattgtcaatcaacagacaccattggtacttatgtcttcgaactgcgaaccaaggtcaccgtcctgggtcagaccccg

SEQ ID NO: 328620 - DNA, 509 bp, Homo sapiens
  misc_feature: GZ8MTXP02G5SCD.51.59.F04.1.454.CMB.2.raw
  modified_base (237)..(237): a, c, t, g, unknown or other
  misc_feature (237)..(237): n is a, c, g, or t
  modified_base (438)..(438): a, c, t, g, unknown or other
  misc_feature (438)..(438): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccgggccaggcccctgtgttggtgatgtataaagacactgagacggcctcgagggactcccgtgagcgattctctggctccgaggtcgagggacaacggtcacattggccatcagtggatccgagcaggaggacgaggctgactattatgtacaatcaanagacactattagtacttatgtacttcggaactgaccgaacgaacgtccaccgtcgtcggtccacgaccccg

SEQ ID NO: 328621 - DNA, 546 bp, Homo sapiens
  misc_feature: GZ8MTXP02GWLP1.51.59.F04.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (472)..(472): a, c, t, g, unknown or other
  misc_feature (472)..(472): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaacgntatgcttatggtaccagcagacgccggcacggcccctgtgttggngatgtataaagacacgtgagacggccctcgacgggactcccgtaggacgcgtacttcgtcgtcggcctccgaggtcgaacgggaaccgaacggtcaactagttcggaccagtcaggtggacgtccgaggcgaggaggacgaggctaggacttattattgacatacaanagacactagttgtacttctgtcgttacgactcgacgtaaccgagtacctacggtcgtcggtaccacggaacccg

SEQ ID NO: 328622 - DNA, 508 bp, Homo sapiens
  misc_feature: GZ8MTXP02FYZM4.51.59.F04.1.454.CMB.2.raw
  modified_base (435)..(435): a, c, t, g, unknown or other
  misc_feature (435)..(435): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctcgagggactccctgagcgattctctggctccaggtcaggggacaacggtcacattggccatcagtggagtccagcaggaggacgaggctgactattatgtcaatcaanagacacctattggtacttatcgttcttacggaactgacgaaccgaaggtccaccgtctcgggtcacgaccccg

SEQ ID NO: 328623 - DNA, 520 bp, Homo sapiens
  misc_feature: GZ8MTXP02FWA89.51.59.F04.1.454.CMB.2.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggcccctgagggatcccngagcgattcctctggctcaggtcaggggacaacggtcacagttggaccatcagtggagtccgaaggcagaggcgtaggctgactattagtgtanaatcaacagacaaccattggtacttangtacttggaactgacgacaacggtcaaccgtcctagggtcacgcccgaacggcccaaacccactcgacacttccg

SEQ ID NO: 328624 - DNA, 520 bp, Homo sapiens
  misc_feature: GZ8MTXP02FGJ0C.51.59.F04.1.454.CMB.2.raw
  modified_base (313)..(313): a, c, t, g, unknown or other
  misc_feature (313)..(313): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (510)..(510): a, c, t, g, unknown or other
  misc_feature (510)..(510): n is a, c, g, or t
tcagcgatcgtatacacgaccggtgctcgatttagtacacacacttagggattgggggtgggtccaggaggcagaactctgggtgtctcaccatgtcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagacggccctnaggggatccctgagcgtattcctcgtggctccgaggtcaggggcaacgggtcacagttgccatcagtggagtccaggcagagacgaggctgactattattgacaatcaanacgaacacctattggtacttangtcttcggaaactgacgaccaacggtcaccgtcgtacgggcacgccccgaaaggcccaaaccccnctcgcactcg

SEQ ID NO: 328625 - DNA, 613 bp, Homo sapiens
  misc_feature: GZ8MTXP02JIMKS.51.59.F04.1.454.CMB.2.raw
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttatggtaccagcagaacgccgggccaggcccctgtgttggtgatgtataaagacactgagacggcctcgagggactccctgacgcgtattcctctggccttcgaggtcgagggacaacggtcacagttcggccagtcagtggacgtccgaggcaggaggacgagggtctagtaccgtatttagtcgtactaactacaaacgagaaacctaccgtaagttttacgggttaaccctttaagtttacggttaccgttttaccgggaaaccgtttacggacccggtaaaccgtaaaccggttacccgtaaccccggttaccgttcgggggttacccacggtaaaccccccggg

SEQ ID NO: 328626 - DNA, 520 bp, Homo sapiens
  misc_feature: GZ8MTXP02G0PAB.51.59.F04.1.454.CMB.2.raw
  modified_base (237)..(237): a, c, t, g, unknown or other
  misc_feature (237)..(237): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccggccaggcccctgtgttggtgatgtataaagacactgagaggcctcgagggactccctgagcgattctctggctccgaggtcagggacaacggtcacacgtggcccatcaggtggacgtccgaggcaaggaggacgagggctggactattattgtacaatcaaacagacacctattggtacttatgtcttacggaactcgacgaaccgaaggtccaccgtcgtacgggtccacgaccccg

SEQ ID NO: 328627 - DNA, 517 bp, Homo sapiens
  misc_feature: GZ8MTXP02GFZA7.51.59.F04.1.454.CMB.2.raw
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcgagggactccctgagcgattctctggctccgaggtcagggacaacgtcacattggccatcagtgagtccagcagaggacgagctgactattattgtacaatcaacagacacctattgtacttatgttcgttacggaactgtacgaaccgtaacggtaccaccgtcgtacgggtccacgaaccccg

SEQ ID NO: 328628 - DNA, 699 bp, Homo sapiens
  misc_feature: GZ8MTXP02HPHSX.51.59.F04.1.454.CMB.2.raw
  modified_base (239)..(239): a, c, t, g, unknown or other
  misc_feature (239)..(239): n is a, c, g, or t
  modified_base (327)..(327): a, c, t, g, unknown or other
  misc_feature (327)..(327): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagccggcaggccctgtgtgtgatgtataagacactgagacggccctgaggatccctgagcgtattccncgtggctccgaggtccgaaggggaccaaacgggtcaaactacgtttacgggaccctaagttccgaaggttacggggaacgttaccccgaaggggccgaaaggggaaacggggaaccgggaaggggtaccgttagggtaaacctttaagtttaaagtttacggttactaaaacgtttaccaaaacgtaacgaacctaaaccctaagtttacggtaaactttagttacgttaccgtttacggaaaccttggacccgtaaccgtaaacggttcccgtaacccggttacccgtcgggggttacccaaaccggtaacccccgaaaacgggaccccccaaaacccccgtaccgtaccggtaccctaaccgtttccccg

SEQ ID NO: 328629 - DNA, 588 bp, Homo sapiens
  misc_feature: GZ8MTXP02IVCEZ.51.59.F04.1.454.CMB.2.raw
  modified_base (222)..(222): a, c, t, g, unknown or other
  misc_feature (222)..(222): n is a, c, g, or t
  modified_base (461)..(461): a, c, t, g, unknown or other
  misc_feature (461)..(461): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttattggtaccagcagaacgccgggccacggcccctgtgttggtgatgtaataaagacactgagacggccctagagggactcccgtgagcgtattcctcgtcggcctcgaggtccgacgggacgaaacgggtcaacgtagttcggacccagtcgaggtcggagtacccgaggcaagggacggacggaggctagtacttattattagtacaatacaanacgaaccactagttacggtacttagtcgttacgttcgaaacttcggacgtaaccgtaggtacctaccggttccgtacgggtacacgaacccgaacggaccccaaacccacgtcgtaccaccgttccg

SEQ ID NO: 328630 - DNA, 517 bp, Homo sapiens
  misc_feature: GZ8MTXP02JFKCA.51.59.F04.1.454.CMB.2.raw
  modified_base (256)..(256): a, c, t, g, unknown or other
  misc_feature (256)..(256): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagacggccctcgagggactccctgagcgattctcgtcggctccgaggtcagggacaacggtcacagttcggccatcagtggagtccgagcaggaggacgaggctagacgttattagtgtacaatcaacagacaccattggtacttatcgtacgttcgaactgaccgaaccgaggtcaccgtcgtcggtacacgacccg

SEQ ID NO: 328631 - DNA, 670 bp, Homo sapiens
  misc_feature: GZ8MTXP02F4GQ5.51.59.F04.1.454.CMB.2.raw
tcagcgatcgtatacacgaccggtgctcgatttagtacacacacttagggattgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccggccagcccctgtgtggtgatagataaagacactgagacgccctgaggactcccgtgacgcgtattccctcgtcggtctaccgaggtaccgaaggggaccgaaacgggttccaaacgtacgttcgggaccctaagtccgtaaggtcggacgtcccgaaggccgaaggaaggacggaaggtcgtaggtaacttaagtttaagttacgtaactaaacttacaaaacgaaacgaactaaccctagtttacggttaactttaagtcgttaccgttacgggtaacttacggaccgtaaaccgtaaacggtcccgtaacccgttccgttacggggtaccaaccggaacccccgaaacgggaccccccaaaacccccggtaccttaccggtacctaaccgtttaccccg

SEQ ID NO: 328632 - DNA, 562 bp, Homo sapiens
  misc_feature: GZ8MTXP02GKMUO.51.59.F04.1.454.CMB.2.raw
  modified_base (243)..(243): a, c, t, g, unknown or other
  misc_feature (243)..(243): n is a, c, g, or t
  modified_base (403)..(403): a, c, t, g, unknown or other
  misc_feature (403)..(403): n is a, c, g, or t
  modified_base (481)..(481): a, c, t, g, unknown or other
  misc_feature (481)..(481): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctcgtgganatgcattcgacccaaacgatatgtcttagttcggtaccagcaagaacggcccgggaccacggcccctgtgttggtgatgtaataaagactactgagacggccctacgagggactcccgtgacgcgtattcgtcgtgcctcgaggtcaagggacaacggtnacgtagtcggactatcgaggtcggacgtccgaggacaggacggacgaggctaggacttattagttagactaatacaanacgacacctattacgtactttagtcgtacgttcgaactgaccgaacgtacgtaccaccggtccgtagggccacgaaccccg

SEQ ID NO: 328633 - DNA, 561 bp, Homo sapiens
  misc_feature: GZ8MTXP02JVXQ8.51.59.F04.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaaccgntatgcttattggtaccagcagaagccgggccaggcccctgtgtggtgatgtataaagacacgtgagacggccctcgagggactcccgtggacgcgtattcctcgtgggcctccgagggtacgaacgggaacaaccgggtcactaagttcggaccagttcgaggtcggacgtccgaggcaggaggacgaggctagacttattacgttgactaatcaacgtagacacctagttcgtacttagtcgttacgtacgaacgtcgacgaaccgtacggtaccgtaccggtcgtcggtaccgacgaaccccgg

SEQ ID NO: 328634 - DNA, 607 bp, Homo sapiens
  misc_feature: GZ8MTXP02JKKDS.51.59.F04.1.454.CMB.2.raw
  modified_base (509)..(509): a, c, t, g, unknown or other
  misc_feature (509)..(509): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgtcttattcggtaccagcaagaacggccggccacggcccctggtgttggtgatgtaataaagacacgtgagacggccctacgagggactcccgtagagaccgtattcctcgtcggtcctcccgagggtacgaacgggggaaccaaaccgggttcaacgtaagttcggtacaacgttcgaaggtcgggacgtccgaggccgaggacgggacggtagcgtaggtacttattagtgtacaatcaacganacactagttggttacttagtcgttacgttacgaaacttcgaccgtaaccgaaacgggtccctacccggttccgtacggggttaccacggaacccccgg

SEQ ID NO: 328635 - DNA, 651 bp, Homo sapiens
  misc_feature: GZ8MTXP02IVM19.51.59.F04.1.454.CMB.2.raw
  modified_base (309)..(309): a, c, t, g, unknown or other
  misc_feature (309)..(309): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgcttattggtaccagcagaacgccggccacggcccctgtgttggtnatgtaataaagacactgaggacggccctcgaggggactcccgtggacgacgtattccgtcgtcgggtcctacccgtagggtacgaagggggtaccaaaccgggtcaaccgtagttcgggacccagttcgaggtcggacgtacccgagggcaaggacgggacggaggtctaggtacttagttattcgtacgtaatacaaacgaacgacctaaccgtagtttacgggttaactttagttacggttaccgtttaccggggaaaactttcggaaccggaacccggtaaacggttacccgtaacccggttcccggttacggggttacccaacccggtaaacccccgg

SEQ ID NO: 328636 - DNA, 527 bp, Homo sapiens
  misc_feature: GZ8MTXP02FKKXE.51.59.F04.1.454.CMB.2.raw
tcagcgatcgtatacacgaccggtgctcgatttagtacacacacttagggattgggggggagcctagctgtgctgtgggtccaggatgcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgtggtgatgtataaagacactgagaggccccctcagggatccctgagcgattctctggctccaggtcagggacaacggtcacattggccatcagtggagtccgaggcagaggacgaggctgactattatgtacaatcaacagaacaaccattggtacttagtcgttcgtttacggaacttgaaccgaacctaaaacggtccaacccggttccgtacggggttaccaaaccgg

SEQ ID NO: 328637 - DNA, 568 bp, Homo sapiens
  misc_feature: GZ8MTXP02FUWS5.51.59.F04.1.454.CMB.2.raw
  modified_base (239)..(239): a, c, t, g, unknown or other
  misc_feature (239)..(239): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccacggcccctgtgttggtgatgtataaagacactgagaggccctcgagggactcccgtgagcgattcctcgtggctcgaggtcagggcaacggtcacattcggacatcagtgagtcgaggcagaggacgaggctgactattattgacaaagtcaacagacaacctagttaggtacttatgtacgttacggaacttgaccgaacgtaaacggtcctaaccggttccgtacggggtaccaaccggaaccccgaaaacgggacccccaaaacccccgacgttaccggtaccaaccgtttcccg

SEQ ID NO: 328638 - DNA, 552 bp, Homo sapiens
  misc_feature: GZ8MTXP02JYPES.51.59.F04.1.454.CMB.2.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (547)..(547): a, c, t, g, unknown or other
  misc_feature (547)..(547): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtgnatgtataaagcactgagacggccctgagggactcccgtgacgcgtattccctcgtggcctccgaggtccgaggggaccaacgggtcacagttggcctaatccgaagtggaagtcccgaaggctaaggaggaaccggaggcgtagacttattatgtacaagtacaacagaacacctaagtttggtaacttatgtcttacgactgaccgtacgaacgtcaccgtcgtcgggtacacgaacccgaacggcccaaacccgctcggtacccnctccg

SEQ ID NO: 328639 - DNA, 554 bp, Homo sapiens
  misc_feature: GZ8MTXP02FQEMH.51.59.F04.1.454.CMB.2.raw
tcagcgatcgtatacacgaccggtgctcgatttagtacacacacttagggattgggggggagcctagctgtgctgtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcaggggactcccgtgagcgtattctctggctccgagtcgacgggacaaacgggtcactattggcccatcgagtggagtccaggcaggaggacggcggctggaactattattgtacaaatacaaacacgaacaccctattacggttaacttattcgtacgtttacgggaaaccttggaccgaaccgaacggtccacccggtccgttcggggtaccacgaacccccgg

SEQ ID NO: 328640 - DNA, 512 bp, Homo sapiens
  misc_feature: GZ8MTXP02GWCEU.51.59.F04.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (415)..(415): a, c, t, g, unknown or other
  misc_feature (415)..(415): n is a, c, g, or t
tcagcgatcgtatacacgaccggtgctcgatttagtacacacacttagggattggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccggcaggccctgtgtgngatgtataaagacactgagaggccctgagggactccctgagcgtattcctctggctccgaggtcgagggcaacggtcacgtattcggccatcgagtggagtccaggcagaggacgagctgatatatgtacaatcaanagacactagttggtacttagtcgtacgtacgactgacgactaacggtccacgtcgtcggtcacgaacccgaacgaccacccacgtcgtacacttccg

SEQ ID NO: 328641 - DNA, 773 bp, Homo sapiens
  misc_feature: GZ8MTXP02I43BD.51.59.F04.1.454.CMB.2.raw
  modified_base (288)..(288): a, c, t, g, unknown or other
  misc_feature (288)..(288): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacgccaggatcacctgctctggagatgctattgaccaaacgatatgcttattggtaccagcagaacgccggcacggcccctggtgttggngatgtaataaagacactgagacggtcctacgaggggtactccccgtagacgtacggtattcccgtcgtcgggtcctaccgtagggttaccggaacggggaccgaaacggggttcccgaaacgtacgttaccgggaccgtaagttaccggtaaagggttcggggtaacgttacccggacggggaccgaaagggggaacgggggaaccgggaacgggtaccgttagggtaaacctttagtttaaacgtttcggttaaacctaaacgttacaaaccgaaacggtaaccaaacccgtaagtttacgggttaaactttaacgttcggtttaccgttaacgggaaccgttcggtaacccggtaacccggtaaacgggttaccccgtacccggttacccgggttacggggttacccaacccggaacccccgtaaacggacccccggttaaaaccccctcggtaccggttacccctaacccggttttccccgg

SEQ ID NO: 328642 - DNA, 686 bp, Homo sapiens
  misc_feature: GZ8MTXP02G1TWD.51.59.F04.1.454.CMB.2.raw
  modified_base (246)..(246): a, c, t, g, unknown or other
  misc_feature (246)..(246): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgactattcgacccaaaccgntatgtacttagttcggtaccagcaagaacgcccgggccacggcccctggtggttggtgagttagtaaagtaaagactaacgtaggacggacggcctacggacgggtactcccgtaggagcgtattcccgtcgtcggtcctacggtaggtaccgaaggggaccgtaaacgggtcaaccgtagttaccggacctagtccgagtcggacgtccgaggacgaaggacgggacggacgggacttaggaactttaagtttattacggtacaaaacgttacaaacgacgaacctaacgttaattaacggttactttaagttacgttacttaacggtaactacggtaccgaaaccggtaacggtacccgtacccggttccgtacggggtacccaacggaaccccgaaacggaccccaaacccgtaacgttccgacctaacctttcccg

SEQ ID NO: 328643 - DNA, 475 bp, Homo sapiens
  misc_feature: GZ8MTXP02FH9MD.51.59.F04.1.454.CMB.2.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagcgatcgtatacacgaccggtgctcgatttagtacacacacttagggagttggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgcaaaccgatatgctatgtaccagcagaagccgggcaggcccctgtgttggtgatgtataaaagacaactgagaggcctccagggancctgagcgattcnctggctccagtcaggacaaagtcacattggccatcatgagcagnagagagagngngatatatgtnatanacanacacactagtatatntctacgtactagacgaacgaacgtacgacgcgtcgtcgacgacg

SEQ ID NO: 328644 - DNA, 732 bp, Homo sapiens
  misc_feature: GZ8MTXP02G33GQ.51.59.F04.1.454.CMB.2.raw
  modified_base (248)..(248): a, c, t, g, unknown or other
  misc_feature (248)..(248): n is a, c, g, or t
  modified_base (413)..(413): a, c, t, g, unknown or other
  misc_feature (413)..(413): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttcctcccctcctcactctctgcacaggctctgaggcctcctatgagctgacacacgcccacccgtcggtgtcagtcgtcccccaggaccaggacggccaggatccacctgctctggganatgctattcgaccctaaaccgatactgtacttattcggtaaccagacaggaaccggcccgggtccaacgggtccccttaggttggttgggtagtaagttagtaaattaaacggacgttaacgtaggaccgaacgggtccctaccggacggggtaccttacccggnggacgtacgttacttccgtacgtccggtacccgtaccggtacgggtacggaaacggggtaacccgtaaccggtacctacgtacggttcggacctacgtacggtacggtacggtaaccgtaccggacggtacgaacgggtacgggacggacgggtacgtaggttacttaagtttacgtacgtaacgaaacgtaccgaaacgtaacgtaacctacgttaacgtttacgttactttacggttacggttaccgtaccggacgtcgaaccggtaaccgtaccgtaccggtacccggtccggtacgggtacccgaaccggacccg

SEQ ID NO: 328645 - DNA, 604 bp, Homo sapiens
  misc_feature: GZ8MTXP02F24OV.51.59.F04.1.454.CMB.2.raw
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
tcagcgatcgtatacacgaccggtgctcgattttagtacacacacttagggagttgggggtggggtccaggaggcagaactctgggtgtctcaccatggcctggatccctctacttctccccctcctcactctctgcacaggctctgaggcctcctatgagctgacacagccaccctggtgtcagtgtccccaggacaggacggccaggactcgacctgctctggagatgcattcgaccaaacgntatgacttattggtacagcagacgccggcagccctgtgtggtnagtgataaagtcacgtagagacggtcctacgaagggcttacccggngacgtacgtacttccctcgtcgtactacggtacggtacggaacgggaccgtaaacggtactacgtacgtcgtacagtacggtaacggtggacgtacggaaggacgaagggacgggaccggaaggtacttagaaacttagttagtatactaaactaacaaacgacgaactacgtagtttacgtacttagcgttacgtacgactacgacgacgtaacgtccacggtacgtacggacaccgaaccgaacgacccacctcgtactactacttac

SEQ ID NO: 328646 - DNA, 658 bp, Homo sapiens
  misc_feature: GZ8MTXP02GXSJQ.51.59.F04.1.454.CMB.2.raw
  modified_base (239)..(239): a, c, t, g, unknown or other
  misc_feature (239)..(239): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagcccaccctggtgtcagtctccccaggacagacgccaggatcacctgctcgtgganatgctagttcgaccaaaccgatatgtcttatcggtaacagacaggaacgcccggccgacggtcccctggtgttggtgatagtaagtaaagactacgtagacgacggcctacgacggtactcccgtagacgtcgtattccgtcgtcggtcctaccgtaggtaccgagggaaacccgtaacggttccaacgtacgttacgaccctagttacgaaggtaggaccgtaccgagggaccgaaggaacgggaacgacggtacgtacgtaactttaagttacgttacgtaactaaacgtacaaacgtaacgtaaacctaccgttaagttacggttaaacctttagttacgtttacgttaccggaaacttcggaacccgtaacgtaacggtccgtacccggtacgtaccgtccgaaccgaacccccg

SEQ ID NO: 328647 - DNA, 629 bp, Homo sapiens
  misc_feature: GZ8MTXP02FMFZQ.51.59.F04.1.454.CMB.2.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
tcagcgatcgtatacacgaccggtgctcgatttagtacacacacttagggattgggcacgaccggtgctcgatttagtacacacacttagggattgggggtgggtccaggaggcagaactctgggtgtctcaccatggcctggatccctctacttctcccctcctcactctctgcacaggctctgaggcctcctatgagctgacacagccaccctggtntcagtcgtccccaggacagacgccaggntcacctgctctggagactgactattcgaccaaaccgatactgtctttaagtcggtaccagtcagaacggccgggacacggcccctgtcggttggtgatacgttaataaacggacacgtgaacggacgaccctaggagggtactacccgtgagccgtattctcgtcgcttaccgagtccgaggaaccgtaacggtctaacgtaggtttacggacctagttaccgaagggtttaggtacgtacccgaagggaccgtaaggtaacggaccgggaggtacgtacggtacgttatttacgtacggttacaacgtacaaacgaacgacaaccgtagttacggttacttaagtcgttaccgttacggactccgtacgaccgttaaccgg

SEQ ID NO: 328648 - DNA, 625 bp, Homo sapiens
  misc_feature: GZ8MTXP02JCPJX.51.59.F04.1.454.CMB.2.raw
  modified_base (242)..(242): a, c, t, g, unknown or other
  misc_feature (242)..(242): n is a, c, g, or t
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccagggacagacggccaggatcacctgctcgtgganatgctattcgaccaaacgtatatgtcttatcggtaccagacagaacggccggccacggtcccctgtggttggtagtagtgtaaataaagacacgtagagacggcctacgacggtactccccgtagacgcgttacttccgttcgtcggtccgtaccgaggtacgacgggtaaccgaaccggttcaacgtagtcggaccctagtacgaggtcggacgtacccgaggcgaaaggaggttacggaggtcgtagtacgttatttacgtcgtaactaatacaaagacgaacacctagttacgttaattagtcgttacgttacgtaaacgttcgaaccgtaaccgtaaacggtccgtaaccggtcgttacggtaccgaaccgaaccccgg

SEQ ID NO: 328649 - DNA, 500 bp, Homo sapiens
  misc_feature: GZ8MTXP01DP2U0.51.85.H08.1.454.CMB.2.raw
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagccaccctcagcgtctggggacccccgggnggagggtcgccatctctgtcngaagcagctccaacatcggaagtaatgctgtcaactggtatcaacaactcccaggactccggcccccagacccctcctactatttttaataactgatcagcgggccctcgacggggtccctgaccgattctctgcctcaagtcagcacctcacgcctcctgccatcagtggctccgagtctgagatgaggctgtattnttattgtgcagcgttgggntgaacngcttgtaattgtcg

SEQ ID NO: 328650 - DNA, 509 bp, Homo sapiens
  misc_feature: GZ8MTXP01DVERK.51.85.H08.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctnagcgtctggggacccccgggnggagggtcgccatctcttgtctggaagcagctccaacatcggaagtaatgctgtcaactggtatcaacaactcccaggactcggcccccagaccctcctctattttaanatgatcgagcgggcctcgacggggtccctgaccgtattctctgcctcaagtcaggcacctcacgcctcctcggccatcagtcgggctccgagtcgtagagtatgagctgtattattattgtgcagcgttagggctgaacagccttagtaattgttcg

SEQ ID NO: 328651 - DNA, 499 bp, Homo sapiens
  misc_feature: GZ8MTXP01CLFAU.51.85.H08.1.454.CMB.2.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (343)..(344): a, c, t, g, unknown or other
  misc_feature (343)..(344): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctggcccagtctgtcctgactcagccaccctnagcgtgcggggacccccgggnggaggcncatctcttgtcaggagcagctacaanagtacgaatatgctgtacaatgacacaacacnccagacnccgcccanacctctatatttaanatanannagcgcgtcgcggtccgtcgactactctctcgctacacgacgacgcacncncncctccgtcgcgactcgagtcgctcgcgtgtgagtagtagtgngtgtattattagttgtgtgacgcggnggtaagtagaacgtagtcgttacgtaagttaagtg

SEQ ID NO: 328652 - DNA, 656 bp, Homo sapiens
  misc_feature: GZ8MTXP01ALTAG.51.85.H08.1.454.CMB.2.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (370)..(370): a, c, t, g, unknown or other
  misc_feature (370)..(370): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagccaccctcagcgtctcgggacccccggggnggacggtcgcntctctgtcnggancagctaccaacacgtacggaatatcgtctcgtactaacgtgtactaccaaactacctaccgaggacctcccggaccccacgtaccctcctacttaattttaanaatacgactcgacggcccgggtaccgtcggtacggggtccctacggtacccgtactttcctccgtaccgtaccctaccgtaacgtaccgacggtacctacccgtccgaccgtccccgttacccgtaccggtaccgtacgtccgtacggtccggtacctccgtacggtcgtaggacggtagtacggacgtcgttaagttaacgttttagttacgttcggtacgtacgttacgggttcggttacgggtaagtacgtaacgtacgttcgttacgttaacgttcggttcg

SEQ ID NO: 328653 - DNA, 526 bp, Homo sapiens
  misc_feature: GZ8MTXP01BS1OK.51.85.H08.1.454.CMB.2.raw
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagccaccctcagcgtctcggggacccccgggnggaggtcgcatctctgtcnggaagcagctccaacatcggaagtaatgctgtcaatggtatcaacactccaggactccgcccccagaccctcctctaattttaanaatgatcgagccgggcctcgacggggtccctagacccgtattctctcgccctaccaagtccgacggtccaccctcgacgtccctcccgtcggcctatcgacgtcgggcctccagtctaggagtntggagtctaagtatttattattgtgcaggcgttgggntgcngcttgtaattgtcg

SEQ ID NO: 328654 - DNA, 554 bp, Homo sapiens
  misc_feature: GZ8MTXP01BANEL.51.85.H08.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (530)..(530): a, c, t, g, unknown or other
  misc_feature (530)..(530): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctnagcgtcgtcggggacccccgggnggacgggtcgccatctcttgtcnggaancagctcaacatcggaatatgctgtcaactgtatcaacactccaggactccggccccagaccctcctactattttaanatgatcgacgcgggtcctcgacggggtccctgacccgtattcctctcgcctaccgaagtccgacgcctacctcacgccctccgtcggcctatccgagtcgggactcccgagttcgacgaggtactggaggtcttaaggtatttattagttggtagcgaggttcggttagggaactgaacnggtccttaggttaattaagttccg

SEQ ID NO: 328655 - DNA, 651 bp, Homo sapiens
  misc_feature: GZ8MTXP01CNNPD.51.85.H08.1.454.CMB.2.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (382)..(382): a, c, t, g, unknown or other
  misc_feature (382)..(382): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctggcccagtctgtcctgactcagccaccctcagcgtcgtcggggacccccgggnggacgggtcnccatctcttgtcnggaancagcctaccaacagtacggtaagtaatcgctagtctaaacgttggtaactacaaacctaacctcccgaggacctccggacccccagtacccctcctacttaatttttaaanaatgtactcgacgccgggtacctccggacggggtcccctaggtacccgtatttcctactcgcccttaccgaacgtccgacggaccacccgttcaccgtcccctcccgtacggtccctaacgttccgtacggttcgggaccctacccgtagtccgtaaggacggtagtcggacgttcgtaagttaagtttattaggttgtacggcgttacgggttgggttacgggtaatacgtaacccgtaggttccgttaggttaacttaacgtttccg

SEQ ID NO: 328656 - DNA, 562 bp, Homo sapiens
  misc_feature: GZ8MTXP01CUVUS.51.85.H08.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctggcccagtctgtcctgactcacgccaccctnagcgtcgtcgggacccccgggnggaggtcnccatctcttgtctggaagcagctccaacagtacggaagtaatgctgtacaactggtatcaaacaactccaggactccggcccccagaccctcctatattttaanatgatcacgccggtcctcgacggggtccctgacccgtattctctcgcctccgaacgtcgacgtcaccctcacgccctcccgtcgccatccgtagtcgggtcctccgagtccgtaggacgtgtggagtctaaggtaatttagttagttggtagcgttaggttcggttgggtaatggaacgtgtaccgttaggtaattaacgtttccgg

SEQ ID NO: 328657 - DNA, 555 bp, Homo sapiens
  misc_feature: GZ8MTXP01BU8SE.51.85.H08.1.454.CMB.2.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (411)..(411): a, c, t, g, unknown or other
  misc_feature (411)..(411): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctctcactcactgtgcaggtcctggcccagtctgtcctgactcagccaccctnagcgtcgtcgggaccccgggnggaggtcncatctcttgtcngaancagctcaacatacggaataatgctgtacactgtatcaacactccagactccgaccccagtaccctcctactattttaagtatagactcacggccggtcctcgacgggtccctgaccgtattctctcgcctacagtccgagctacctnacgcctcgtcgactatcgaggtcggtcctccgtagttcgtaggacggtagtcggtaacggtcttaaggtatttaggttacgttgtcgtaccgttaggcgggttagggaattcggaactacggtccttaggttaacttcgtttcg

SEQ ID NO: 328658 - DNA, 594 bp, Homo sapiens
  misc_feature: GZ8MTXP01EV2JO.51.85.H08.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (408)..(408): a, c, t, g, unknown or other
  misc_feature (408)..(408): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctggcccagtctgtcctgactcacgccaccctnagcgtcgtcggggacccccgggnggaggtcgccatctcttgtcnggaagcagctacaacatacggaagtatgctgtctaactgtatcaacaactccgaggactccggccccagtacccctccttataattttaaanaagtanactcgacggtccgggccctcggaccgggtccctgaccgtacttcnctcgcctactacgtcacgccacctcgaccgtccctcccgtcggacccgtcttaccggacggtcggggcccttcccgtacggttccgttaggaaggtcggtacggtacggtcgttaagttaattttagttagttcggtagccgttaggcgttagggaatgaactacggtcttaggtaattaagttcg

SEQ ID NO: 328659 - DNA, 524 bp, Homo sapiens
  misc_feature: GZ8MTXP01CSEGR.51.85.H08.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctggcccagtctgtcctgactcagccacctnagcgtcgtcggggaccccgggnggcggtcncntctntgtngancancacanagtagaatatnctgtactactgtactacaacactccgagacnccgcccataccctcctattatttaanatanatcgacgcggtacctcggacggtcctacgactacttctctctctacacgtcgacgccacctcnccncctccgcgcctacgtcgacggtcgctccgtgtcgaggacgtgtggacgtctaagtaatttattgttgtgcgttaggttggttaggtaagtacgcgcgtcttagtaacttcgttcg

SEQ ID NO: 328660 - DNA, 623 bp, Homo sapiens
  misc_feature: GZ8MTXP01AXX8G.51.85.H08.1.454.CMB.2.raw
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (365)..(365): a, c, t, g, unknown or other
  misc_feature (365)..(365): n is a, c, g, or t
  modified_base (533)..(533): a, c, t, g, unknown or other
  misc_feature (533)..(533): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagcccaccctcagcgtcgtcggggacccccgggnggaggtcgccatctctgttcnggaancagctccaacagtacggaagtaatgctgtcaacgtggtatacaacaacctccaggactccggaccccagtacccctcctactaactttttaaanataacgatcgacgcgggtccctacgacggggtccctacgtacccgtacttctcgtcgccctaccgaaagtccgacgggtccaacccttccgaccgtccccttcccgtcggccctaacgtcgacggttcgggccttcccgaggttccgtaggaggtattcggacgggtntaaggtaatttagtttacgttggtacgtcgttagggccggttaaggggtccttaggaacgtaacggtcccgttaggttaattcgtttccg

SEQ ID NO: 328661 - DNA, 616 bp, Homo sapiens
  misc_feature: GZ8MTXP01A54TX.51.85.H08.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (360)..(360): a, c, t, g, unknown or other
  misc_feature (360)..(360): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagccaccctnagcgtcgtcggggacccccgggnggacgggtcgccatctcttgtcnggaancagctaccaaacatcggaataatgctgtcaactggtataccaacaacctccgaggactccggccccagaccctcctactaattttaanatgatcaggcgggtcctcggacggggtcctagtaccgattctctcgccctaccgagtacgacgtccaccgtcgaccgtccctcccgtcggacctacgtcgtacggttccggggtccttcccgaggttccgtagggaggtacgtcggtaggtaccgtggttaaattttaggtttaagttcggttaggaaccgttcgggttcgggttaggggtaactcgggtaacctaacgggtccttaggtaaactttcgtttccgg

SEQ ID NO: 328662 - DNA, 542 bp, Homo sapiens
  misc_feature: GZ8MTXP01ASM1B.51.85.H08.1.454.CMB.2.raw
  modified_base (110)..(110): a, c, t, g, unknown or other
  misc_feature (110)..(110): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagcgatcgtatacacgaccggtgctcgatttagtatcactcagtcgcgggcacgaccggtgctcgatttagtatcactcagtcgcggggcagcttcagctgtgggtanagaagacaggactcaggacaatctccagcatggccagcttccctctcctcctcaccctctcactcactgtgcagggtcctgggcccagtctgtcctgactcagcccacctcagcgtcgtcggggacccccggnggacggtcgcctatctcttgtcnggaancagctaccaaacngtacggaataatgctgtcaatggtatacaacaactccgagactccgccccagtccctcctatattttaanatagatcgacgccggtcctcgtacggggtccctgaccctattctcncgcctaccagtccagcctaccgcacgtcctccgtcgcctagtcgagtcggctcagtctaggcgtntggacgtntaagtattacgttagttcgtagcgttaggttcggttagggaattcgctacggcttagttaacttcgtcg

SEQ ID NO: 328663 - DNA, 727 bp, Homo sapiens
  misc_feature: GZ8MTXP01DGRC3.51.85.H08.1.454.CMB.2.raw
  modified_base (253)..(253): a, c, t, g, unknown or other
  misc_feature (253)..(253): n is a, c, g, or t
  modified_base (591)..(591): a, c, t, g, unknown or other
  misc_feature (591)..(591): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcgagggtcctgggcccagtctcgtcctgactcacgcccaccctcagtcgtccgtccgggggacccccgggnggacgggtccgcctatcttcgttgtcgtggaacgcagcctacaacagtacggaagtaatgctgtacctaagtaggtactaccaaccaacctccgaggacctcccggaccccacgtaccctcccttacttaattttaaactaatcgaacttcgacgggtccgggtacccgtcggtacccggggttcctacgggtaccttacgttcctacgtcgccctacgtaacgtaccgacggtacctaccgtaccgtaccgtccccttaccccggtccggaccctaaacggttccggtacgggttcccgggtacccgggtaccctacggggttacgtaaaccggggngggttaaaccggtgggtacgggttaacgttaaggtttaatttaaagtttacggtttggtacggtaccgggttaggttccgggttaagggtaacgttacggaacgtccggtacgtttagttaacgttaacgttttcg

SEQ ID NO: 328664 - DNA, 626 bp, Homo sapiens
  misc_feature: GZ8MTXP01EXNLZ.51.85.H08.1.454.CMB.2.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
tcagcgatcgtatacacgaccggtgctcgatttagtatcactcagtcgcgggcacgaccggtgctcgattttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtcgtcggggacccccgggngggacgggtcnccatctcttgttcnggaancagctccaaacatcggaagtatgctgtacactgtatcaacactccaggactccggccccagtacccctcctactaatttttaanaactgactcgaggccgggtacctcggacggggttccctgacccgtattcctctcgccctaccgaagttccgacggacctacccgtacaccgtccccgtacccgtcggacccaacgttccgacggttcgggccctccgtacgttccgtaggtacggtgtggtacggtctgttaattttattagtttgtacggtcgttaacgggttccgggttaggggaatcgggtaaccgtacggtaccgttaggtttaacgtttcgttttcccggg

SEQ ID NO: 328665 - DNA, 501 bp, Homo sapiens
  misc_feature: GZ8MTXP02JRX9F.51.85.H08.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (350)..(350): a, c, t, g, unknown or other
  misc_feature (350)..(350): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctnagcgtctgggacccccggnggagggtcgccatctcttgtctggaagcagctccaacatcggaagtaatgctgtcaactggtatcaacactcccaggactccggcccccagaccctcctcatttttaanatgatcagcgggcctcgaggggtccctgaccgattctctgcctccaagtcaggcacctcacgccctccctggccatcagtcgggctccgagtctgagatgagctgatttagtattgtagcagcgtgggaatgacacggcctgtatacttcg

SEQ ID NO: 328666 - DNA, 494 bp, Homo sapiens
  misc_feature: GZ8MTXP02JS53B.51.85.H08.1.454.CMB.2.raw
  modified_base (241)..(241): a, c, t, g, unknown or other
  misc_feature (241)..(241): n is a, c, g, or t
  modified_base (349)..(349): a, c, t, g, unknown or other
  misc_feature (349)..(349): n is a, c, g, or t
  modified_base (465)..(465): a, c, t, g, unknown or other
  misc_feature (465)..(465): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccggnggaggtcgccatctcttgtctggaagcagctccaacatcggaagtatgctgcaactggtatcaacaactccaggactccggcccccagaccctcctactatttttaanatgatcagcgggcctcgaggggtccctgaccgattctctcgcctcaagtcaggcacctcacgcctcctgccatcgagtcgggcctcgacgtctgaggatgagctgattattatgtncgagcgtggaatgacagcctgtactatcg

SEQ ID NO: 328667 - DNA, 570 bp, Homo sapiens
  misc_feature: GZ8MTXP02FLWA7.51.85.H08.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggccccagtctgtcctgacctcagcccaccctnagcgtctcgggacccccgggnggagggtcgccatctcttgttcnggaagcagctccaacatcggaagtaatgctgtacaactggtatcaaacactcccagactcggccccagaccctcctctatttttaatatgatcgagcgggcctcgacgggtccctcgaccgtattcctctcgccctaccaacgtcacggcctaccctcaccgtccctcccgtcggacctactcgaggtcgggacctcccgagttcaggacgtatcggagtctagtatttagtttagttcggtgtacgacgtcgggttaggggaattacggacgaacggtccgttacggttaactagtttcg

SEQ ID NO: 328668 - DNA, 533 bp, Homo sapiens
  misc_feature: GZ8MTXP02FMHRR.51.85.H08.1.454.CMB.2.raw
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctcgggacccccgggnggagggtcgcccatctcttgttctggaagcagcctccaacatcggaagtaatgctgtcaactggtatcaaacactccaggactccggcccccagacccctcctactatttttaanaatgatcagcggcctcgacggggtccctgaccgtattctctcgcctcaagtcacggccacctcacgccctcccgtcggccactcgaggtcgggcctacccgagtcgtggaggactggagctagtatttattattgtcgcgagcggttgggaatcgacacgtcctagtactattcg

SEQ ID NO: 328669 - DNA, 610 bp, Homo sapiens
  misc_feature: GZ8MTXP02JZ814.51.85.H08.1.454.CMB.2.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (374)..(374): a, c, t, g, unknown or other
  misc_feature (374)..(374): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagcccaccctcagccgtcgtcgggacccccggnggacggtcgccatctcttgtctggaancagctaccaacagtacggaaagtatgctgtacaacgtggtactaccaaacctacctcccgaggacctcccggccccaagtacccctcctactaatttttaaanatgatcgaggccggcctgacgggtccctagacccgtattcctctcgccctacgaacgtcgacgcctaccctcgaccgtccctcccgtcggaccctacgtcgagggttccgggcctccgtacggttcgtagggaaggtgttcgggaaggtcttaggtaatttagttacgttggtcggacgtacgggcggttagggaacgttacggacgtacggttccgtgttaacgttcgtttccgg

SEQ ID NO: 328670 - DNA, 625 bp, Homo sapiens
  misc_feature: GZ8MTXP02F9P1V.51.85.H08.1.454.CMB.2.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctgggcccagtctgtcctgactcagccaccctnagcgtctgggaccccccgggnggaggtcncatctcttgtcnggagcagctaccaacagtacggaagtaatgctgtacaacgtggtactaccaaaccaacctcccgaggaccgtcccggaccccccagtaccccttcccttacttaatttttaaataatagactcgacggccgggtcctcggtacggggttccctacgtaccgtacttcctccgtcgtaccctaccgaacgtccgacggaccacccgtccaccgtcccctccccgtcggcctactccgtaggtcgggcctccgacgtcgtaggaggtagtaggacggtacgttagttaatttaagtttacgtttggtcgacgtacggtcgggtaggggtaagtcggaacgtacgtccgttagttaacttacgtcg

SEQ ID NO: 328671 - DNA, 688 bp, Homo sapiens
  misc_feature: GZ8MTXP02JLJWC.51.85.H08.1.454.CMB.2.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcaggtcctggcccagtctgtcctgactcacgccaccctcagcgtcgtcgggacccccgggnggcggtcgcnctctcttgtcgtagacncacgctaccaacagtacggtaatatgctgtactaagtgtactacaacctaacctaccgagaccgtacccggaccccgtacgtacccctacctactttaacttttaaactaactgactccgacggccggtcctacgtaccgggtccctacggtaccgtacttccttccgtcgtacccgtaccgtaacgtaccgaaccggtaccctacccgtaccgtacccgtccccgttacccgtaccggtacctacgtaccggtacgggtcgggtaccctaccggtacggtacggtagggtaacggtagtacgggtacgtacgttaacggttaacgttttagttacggtttcggtacgtaccggtacgggtacgggttagggtaacgtacggtacggtacgttaccgttagttaaccgttagtttccg

SEQ ID NO: 328672 - DNA, 653 bp, Homo sapiens
  misc_feature: GZ8MTXP02GFFGP.51.85.H08.1.454.CMB.2.raw
  modified_base (246)..(246): a, c, t, g, unknown or other
  misc_feature (246)..(246): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagccttccctctcctcctcaccctcctcactcactgtgcagggtcctgggcccagtctgtcctgactcagcccaccctcagcgtcgtcgggacccccgggnggacgggtcgccatctcttgttcnggaancagctaccaacagtcggaagtaatgctgtctaacgtggtactaccaaacaacctcccgaggactcccggacccccagacccctcctacttaatttttaacaatcgatcaggccgggtacctccgtacgggttcccgtagacccgtactttcctcgtcgtacccctacgtaaacgtccgaacgccacccctacgaccgtccccgtcccgtacggaccctacgtaccgtacgggttcggggcccttaccggtacgttccgttagggaggtagtacgggacgtcgtagttaatttaagtttacgtttcggtgtaccgtaacgggtcgggttacggggaagttaccgaacgtacggtcccttaggtaagtttaactttccgg

SEQ ID NO: 328673 - DNA, 536 bp, Homo sapiens
  misc_feature: GZ8MTXP02G0U7D.51.85.H08.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
  modified_base (447)..(447): a, c, t, g, unknown or other
  misc_feature (447)..(447): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctggaccctgtctgtcctgactcagccacctnagcgtcgtcgggaccccggngaggtccncatctcttgttcngaancagcctacaantacggaatangtctgactaatgtatacaacactccgagactccgacccagacccctctacttaattttaagatcancgagcggtcctgaccgggtctacgacgtacttctctcgacctacaaacgtcgacgtacaccctcacgtcctacgcacatcgagtcgcttaccgngtgagagtcgagtagtcttagttattattacgtcgtacgcgtacgtacggtagtaagtacgtacgtacgtacgtacgtacgttacgtcg

SEQ ID NO: 328674 - DNA, 518 bp, Homo sapiens
  misc_feature: GZ8MTXP02IJ04D.51.85.H08.1.454.CMB.2.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctctcactcactgtgcagggtcctgggcccagtctgtcctgactcacgccacctcagcgtcgtcgggacccccgggnggacggtcncatctntgtgagancancacaanagacgaatangctgtacagtgtacacaacactaccgagacnccgacccatacctacctatatttaanatnatcgcgcgcctacgacgtcagactatcnctcgcctacgaacgtcgacgacactcacncctccgtcgacactacgagtcgtctcgacgtagtagagagtagagtacgtagtattattagttagtacgtacgtacgtagtaggaagtacgacgacgtacgtacgtacgtacgtcg

SEQ ID NO: 328675 - DNA, 593 bp, Homo sapiens
  misc_feature: GZ8MTXP02HP4U9.51.85.H08.1.454.CMB.2.raw
  modified_base (242)..(242): a, c, t, g, unknown or other
  misc_feature (242)..(242): n is a, c, g, or t
  modified_base (355)..(355): a, c, t, g, unknown or other
  misc_feature (355)..(355): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctcgggaccccgggnggaggtcgcatctcttgtctggagcagctccaacatacggaagtaatgctgtcaatggtactacaactaactcccaggactccggccccagtacccctcctactatttttaanaatgatcagcggcctgacggggtcccagacccgattctctcgcctaccagtcacgcacctcacgtccctcccgtcggccacgtcgtacggtcgggccttccgacgttcgtacggtaggagttacggacggtaccgttacggtagttttaagtttacgtttgggttacgtccgtagggtcccggtaggggtaacgttcggaaccgtacgtacccgtttaggtaaactttacggtttccg

SEQ ID NO: 328676 - DNA, 592 bp, Homo sapiens
  misc_feature: GZ8MTXP02GQKES.51.85.H08.1.454.CMB.2.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcagggtcctgggcccagtctgtcctgactcacgccaccctcagcgtcgtcgggaccccgggnggacggtcgcatctcttgtctaggancagcctaccaacagtcggaaagtatcgctgtcaacgtggtactacaaccaacctccgaggactcccggaccccagacccctcctactaattttaanatcgactcgagccggctcgacgggtcctgacctnttcnctncctcaagtcacgcactcactccctcctgccactcgacggtcgggtacctcgtacgtcgtaggtaacggtgtacggtacgggttcgttaagttaagtttagtttacggtacggtacgtacggtacgggtcggttaacgggtaacgtaacggtaccgtacgttacgttaacgttacgttacgtttcg

SEQ ID NO: 328677 - DNA, 593 bp, Homo sapiens
  misc_feature: GZ8MTXP02HG7UI.51.85.H08.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagcttccctctcctcctcaccctcctcactcactgtgcgagggtccgtgggcccagtctcgtcctgacctcacgccacctnagccgtccgtcggggacccccgggnggacgggtccgcatctcttagttcaggaagcagctacaactgtacggaagtatgctgactaatgtaanacaactaacctccgaagtacgcccggtaccccagtaccctacctattaattttaanatgactcgagcggtacctgacggggtccnggtacctcttctcgtcgcctatacgtcgacgcctacncgacctcctcccggtatccacgttcgcggttccggccttaccggagtacggaggtagtacggtacgtagtacttacgttagtttatacggttggacgacgtacgggtgggtaacgtgtaacgaccgttacgtacttacgtaacttacgttcg

SEQ ID NO: 328678 - DNA, 553 bp, Homo sapiens
  misc_feature: GZ8MTXP02FL5WJ.51.85.H08.1.454.CMB.2.raw
  modified_base (155)..(155): a, c, t, g, unknown or other
  misc_feature (155)..(155): n is a, c, g, or t
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (504)..(504): a, c, t, g, unknown or other
  misc_feature (504)..(504): n is a, c, g, or t
tcagcgatcgtatacacgaccggtgctcgatttagtatcactcagtcgcgggcacgaccggtgctcgatttagtatcactcagtcgcggggcagcttcagctgtgggtagagaagacaggactcaggacaatctccagcatggccagccttcccnctcctcctcaccctcctcactcactgtgcgaggtcctgggcccngtctgtcctgactcacgccacctnagcgtcggtcgggaccccgggnggaggtccnctctctcgtgtcgagacgcacgctacacgagtagtatatcgtctagtactacgtagactaccaacaccgccgagccnccgaccatccctactattaattanangtncgcgtcgtctcgtacgtctacgctntctcctcgactacgcgcacgccncctcnccgcctccgcgtactcgtcgcggtccgtacctacgtggtcgaggtacggtacgtacggtacgttcttaggttattaggttacgtggtacgnggtacggtggtacggaacgtagacgtcgttacgttacgtacgttcgtcg

SEQ ID NO: 328679 - DNA, 684 bp, Homo sapiens
  misc_feature: GZ8MTXP02FKXC7.51.85.H08.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
  modified_base (653)..(653): a, c, t, g, unknown or other
  misc_feature (653)..(653): n is a, c, g, or t
tcagcgatcgtatacacgaccggtgctcgatttagtatcactcagtcgcgggcacgaccggtgctcgatttagtatcactcagtcgcgggggcagcttcagctgtgggtagagaagacaggactcaggacaatctccagcatggccagccttccctctcctcctcaccctctcactcactgtgcagggtcctgggcccagtctgtcctgactcacgccaccctnacgcgtcgtcgggacccccgggnggacgggtcgccatctcttcgtctggacncacgctccaacagtacggaagtactgctcgtcaaacgtggtactacgaaacctaacctccgaacggtacctccgggacccccctagacccccttaccctacttaactttttaaanaattcgaacttccgacgggtaccgggtacccgttaccgacccgggggttaccctacgtacccggtactttccgttcctccggtaccctccccgtaaacggttccgaaccgggtccctaaacccgttccgacccgtcccccttaccgtaccggaccctagtacccgtacgggttcggaccttcccgtacgtacgtaggacggtagtaggcggtacgttagtaacgtttagtttcgttgtacggtacgacggttgtacggggtntacggacgtacggccttaggtacttgttccg

SEQ ID NO: 328680 - DNA, 530 bp, Homo sapiens
  misc_feature: GZ8MTXP01EWA4U.45.51.E07.1.454.CMB.2.raw
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (408)..(408): a, c, t, g, unknown or other
  misc_feature (408)..(408): n is a, c, g, or t
  modified_base (497)..(497): a, c, t, g, unknown or other
  misc_feature (497)..(497): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggacaagggcttgagtgctgggaaagntcatccctgagtacgggctagtacgactagcacagaaagttccngggcagactcacgataccgcgacaaatcgacgagcacgccttnatggaactagcagcctaggaagtctagaagacacggcctaatacttactgtgcgaggaatattcgtgagtggcttcgttagaacttcgnggggccaggggaccccttgggtccaaccgtccc

SEQ ID NO: 328681 - DNA, 540 bp, Homo sapiens
  misc_feature: GZ8MTXP01A1NA8.45.51.E07.1.454.CMB.2.raw
  modified_base (272)..(272): a, c, t, g, unknown or other
  misc_feature (272)..(272): n is a, c, g, or t
  modified_base (368)..(368): a, c, t, g, unknown or other
  misc_feature (368)..(368): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgngacttgggtgcgacaggcccctggacaagggcttgagtggctgggaaagatcatccctgagtacgggctagtacgactacgcacagaaagttccgngggcagactcacgattaccgcgacaaatcgacgagcacgcttcatggaactagcagcctaggaagtctagaacgacacggccgtaatattactgtgcgaggaagtattcgttgagtggcttccgttagagtaacgtggggccacggggtacccttgggtccaacccggtccc

SEQ ID NO: 328682 - DNA, 527 bp, Homo sapiens
  misc_feature: GZ8MTXP01DJ1YB.45.51.E07.1.454.CMB.2.raw
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
  modified_base (520)..(520): a, c, t, g, unknown or other
  misc_feature (520)..(520): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggccccctggacaagggcttgagtggctgggaaagatcatccctgagtacgggctagtacgactacgcacagaaagttcngggcagactcacgattaccgcggacaaatcgacgagcaccgcttcatggaactagcagcctggaagtctagaagacacggcctatatactgtgcgnggaatattcgttgagtggcttccgttgataacgtggggccaggggacccttggtccnccgtccc

SEQ ID NO: 328683 - DNA, 521 bp, Homo sapiens
  misc_feature: GZ8MTXP01CC9QC.45.51.E07.1.454.CMB.2.raw
  modified_base (272)..(272): a, c, t, g, unknown or other
  misc_feature (272)..(272): n is a, c, g, or t
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
  modified_base (514)..(514): a, c, t, g, unknown or other
  misc_feature (514)..(514): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgngacttgggtgcgacgaggccccctggacaagggcttgagtggctgggaaagntcatcccgtgagtacggctagtacgactacgcacagaaagttccngggcagactcacgatacgcgacaancgacagcacgcttcataggaactagcagcctaggaacgtctagaagacacggcctatattactgtgcgaggaatattcttgagtggcttcgttagatcgtgggccagggacccttggtcnccgtccc

SEQ ID NO: 328684 - DNA, 557 bp, Homo sapiens
  misc_feature: GZ8MTXP01D9PXW.45.51.E07.1.454.CMB.2.raw
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctcttttgtggtggcagcagctacaggcggccagtcccaggtccagttggtgcaatctgggtctgaaatgaagagcctgggtcctcggtgaaggtctcctgtaggcttctggagctccttcagcagctacagtgtgacttgggtgcgacaggcccctggacaagggcttgagtggctagggaagatcatccctgagtacggntagtagactacgcacagaaacgttccngggcagactcacgattaccgcggacaaagtcgacgagcacccgcttacatggaacctaagcaagcctagggaacgtcgtagaagaccgacggccgttataattactgtgacggaggaagttattcgttgagtcggtcttaccgttgaagttaacgtcgggccgacggggaccccttgggtcccaacggtcccc

SEQ ID NO: 328685 - DNA, 548 bp, Homo sapiens
  misc_feature: GZ8MTXP01BUEWW.45.51.E07.1.454.CMB.2.raw
  modified_base (206)..(206): a, c, t, g, unknown or other
  misc_feature (206)..(206): n is a, c, g, or t
  modified_base (365)..(365): a, c, t, g, unknown or other
  misc_feature (365)..(365): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctgtagggccagtcagactattaccagcaacttagcctggtatcagacaaaaacctggaccaggcctccccggctcctcatctctgtgcacacaccagggccactggtactcccagccaggttcagtggcaggtgggtctagggacncggggttcctcgtcaccgatcggacgggctacgagtctagaagtatttgacgtagtttattactgtcatcagtatcatcgaggggcacgtagtttggccgtaggggaccaagtcgtggaacagttacaaacgaacgtggtggaccttgactaacctatcgttgtcttctaacttccttccccg

SEQ ID NO: 328686 - DNA, 604 bp, Homo sapiens
  misc_feature: GZ8MTXP01DO665.45.51.E07.1.454.CMB.2.raw
  modified_base (321)..(321): a, c, t, g, unknown or other
  misc_feature (321)..(321): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctggtgaaggtctcctgtagggcttcgtggagctccttcagcagctacagtgtgacgttgggtgcgacaggcccctggacaaggcttgagtggctagggaaanatcatcccgtgagtacggctagtacgactacgcacagaaagttccaagggcagactcgaacgacttaccgacggaacaaacgtcgaacgagccacccgtacccttacaatacggaaactaaggcaagaccctaggggaagttcgtagaaacgacgaaccggtaccgttaattaagttactggtagacggaaggtaagtaagttcgtttaggagttcgggcttaccgtttagaaacgttaacgtggggaaccctaggggaaccccttggtcccgaaccgtcccc

SEQ ID NO: 328687 - DNA, 537 bp, Homo sapiens
  misc_feature: GZ8MTXP01AMH7M.45.51.E07.1.454.CMB.2.raw
  modified_base (322)..(322): a, c, t, g, unknown or other
  misc_feature (322)..(322): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggacaagggcttgagtggctgggaaagntcatcccgtgagtacggctagtacgactacgcacagaaagttcccaagggcagactcacgataccgcggacaaatcgacgagcacgccttcatggaactagcagcctaggaagtctagaacgacacggccgtatatactgtgcgaggtaagtattcgttgagtggcttccgttagactcgtcgggccgacgggacccttggtccgaaccgtcccg

SEQ ID NO: 328688 - DNA, 631 bp, Homo sapiens
  misc_feature: GZ8MTXP01CQZ0X.45.51.E07.1.454.CMB.2.raw
  modified_base (335)..(335): a, c, t, g, unknown or other
  misc_feature (335)..(335): n is a, c, g, or t
tcagacgcgatcgacacgaccggtgctcgatttagcatactctacaacacacaaaggggacgttacaaccacattcctcctctaaagaagccccctgggagaacagctcatcaccatggactggacctggaggctcctctttgtggtggcagcagctacaggcggccagtcccaggtccagttggtgcaatctgggtctagaaatgaagaagcctggtcctcggtgaaggtctccgtgtaggcttcgtggagctccttcagcagctacagtgtgtacgttgggtgcgacgacggcccctaggacgaagggtcgttggagtggacgtagggaaagntcaagtcccgtgacgtacgggctagtacgactacgcacgagtaaacgttccgaagggcagacctacgacgataccgacgaacaagtcgaacgagccgaccgcttacagtaggaaactagcagtacctagggaacgttcgagaacgaccgacggtaccgttatacgttacgtgtacggacgagggtaagttaagttcgttagaggttcggtcctttaccgttaagttaaacgttccgggtacggggaacccgtaacgggggtaaccccttcgggtaacccgttaaccccggttcccc

SEQ ID NO: 328689 - DNA, 601 bp, Homo sapiens
  misc_feature: GZ8MTXP01BGYU9.45.51.E07.1.454.CMB.2.raw
  modified_base (324)..(324): a, c, t, g, unknown or other
  misc_feature (324)..(324): n is a, c, g, or t
  modified_base (371)..(371): a, c, t, g, unknown or other
  misc_feature (371)..(371): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctggtgaaggtctcctgtaggcttcgtggagctccttcagcagctacagtgtgacttgggtgcgacgacggcccctggacgaagggcttggagtggcgtagggaantcagtccgtgagtacggctagtacgactacgcacagaaacgttccgngggcagactcgacgtactaccgacgacaaagtcgacgacgaccaccgtccttacatacggaaactaagcaacgtccctaggggaacgtccgtaagaaacgtaccgaccggtaccgttaattacttacgtgtacgacggaaggtaacgttattcgttgacggtcgtcttaccgttagaagttaacggtcggggaaccgacggggtacccttggtaacccgaacccgtcccg

SEQ ID NO: 328690 - DNA, 578 bp, Homo sapiens
  misc_feature: GZ8MTXP01AHMQU.45.51.E07.1.454.CMB.2.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (398)..(398): a, c, t, g, unknown or other
  misc_feature (398)..(398): n is a, c, g, or t
  modified_base (495)..(495): a, c, t, g, unknown or other
  misc_feature (495)..(495): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctgtagggccagtcagactataccagcaacttgcctggtatcagacaaaaccnggccaggcctccccggctccctcatctctggtgcacacaccgagggccactggtactcccagccaggttcaggtggcaggtgggtcgtggggactggggttccgtctcaccagtcgacgggctacgngtctgaagttattttgacttagtttattacgtgttactatctagttatcgtagttcgaggggctacgtagtttcgggaccgaggggtaccaagtcgnggaagacttaacgaaacgaacgttggtcggttacgttcgacctaaccctgttcgttcgttccttcctaacgtttcccgtcccg

SEQ ID NO: 328691 - DNA, 708 bp, Homo sapiens
  misc_feature: GZ8MTXP01BDZK2.45.51.E07.1.454.CMB.2.raw
  modified_base (248)..(248): a, c, t, g, unknown or other
  misc_feature (248)..(248): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctccgtgtagggcttcgnggagctccttcagcagctacgagtgtgacgttgggtgcgacgacggccccgtggacgagggtcttggaggtggcgtagggaaagatcatccgtgacgtacggctagacgactacgcacagtaaacgtccgaaggcaagactcgacgacgttaccgacggaacaaacgtcgaacggacgaccgtaacccgtaccttaccgaagttacgggaaaaccttaagaccgtaacggtaccccgttaaggggaaacggttcccgtaaggaaaaccggtacccgaaccggggtacccttaaagttaaccgtttaaccgtcgggttagaaccgggaaggttaagttaacgtttacggttaggacgggtttcggtacgtttacccgttaaggttaaaccgttaaccggtcgggggtaaccccgtaaacgggggtaaccccttcggggttaaccccgaaccccggtccccg

SEQ ID NO: 328692 - DNA, 599 bp, Homo sapiens
  misc_feature: GZ8MTXP01CQ7LL.45.51.E07.1.454.CMB.2.raw
  modified_base (276)..(276): a, c, t, g, unknown or other
  misc_feature (276)..(276): n is a, c, g, or t
  modified_base (380)..(380): a, c, t, g, unknown or other
  misc_feature (380)..(380): n is a, c, g, or t
  modified_base (493)..(493): a, c, t, g, unknown or other
  misc_feature (493)..(493): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctccgtggtagggcttcgtgggaggctccttcagcagctacagtgngacttgggtgcgacgacggcccctggacaagggcttgagtggcgtagggaaagagtcactcccgtgacgtacgggctagtacgactacgcacagaaacgttccnggcagactcacgacttaccgcgacaaagtcgacgacgccaccgacttcagtaggaactacgcaagccgtaggacgtctagaacgacgacggaccgtattacttacgtgtacgnggaggtaattaacgttcgtttggacgttcggtcttaccgtttagaaacgttaacggtcggggaaccgaacggggtaaccccgttcgggtcccttaacccggtcccc

SEQ ID NO: 328693 - DNA, 654 bp, Homo sapiens
  misc_feature: GZ8MTXP01B3KM5.45.51.E07.1.454.CMB.2.raw
  modified_base (323)..(323): a, c, t, g, unknown or other
  misc_feature (323)..(323): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttcgtggaggtctccttcagcagctacagtgtgacgttgggtgcgacaggcccctggacagggcttgagtggctgggaagntcatcccgtgagtacggctagtacgactacgcacagaaacgttccgaagggcagactcgacgacgttaccgcggaacaaagtccggaacgacgaccgacccggtccttacgaagttacgggaaactaacgcgaacgtacccgtagggggaaacgttccgtaaggaaacggacccgaaccgggtacccgttaattacgttaaccgtggtcgacggtaagggtaagtaagttcgttaggagttcgggtccttccggttaaagaacgtttaaccggtcgggggaacccgtaacgggggtaaccccttcggggttaacccaacccgggttccccg

SEQ ID NO: 328694 - DNA, 590 bp, Homo sapiens
  misc_feature: GZ8MTXP01A9ORH.45.51.E07.1.454.CMB.2.raw
  modified_base (206)..(206): a, c, t, g, unknown or other
  misc_feature (206)..(206): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaangccaccttctcctgtagggccagtcagactattaccagcaacttagcctggtatcagacaaaactgccaggcctcccggctcctcactctctggtcgcacaccaccgacgggccacgtggtactccccgagccaggttcacggtggcgaggtgggtcgtagggacgtcggggttccctctcaccgagtcggacgggctacgngtcgtagaagttntttgacgttagtttattacgtgtcatctagtactctagtaccgaggggtctacgttaggtttcggaccgaggggtaacccaaggtcgtaggaagtacgttaacgaaacgttacgtggtcggcgttcgccaacctgttccttgttccttactaaccgtttcccttccccg

SEQ ID NO: 328695 - DNA, 548 bp, Homo sapiens
  misc_feature: GZ8MTXP01BW0PD.45.51.E07.1.454.CMB.2.raw
  modified_base (325)..(325): a, c, t, g, unknown or other
  misc_feature (325)..(325): n is a, c, g, or t
  modified_base (513)..(513): a, c, t, g, unknown or other
  misc_feature (513)..(513): n is a, c, g, or t
  modified_base (534)..(534): a, c, t, g, unknown or other
  misc_feature (534)..(534): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctagaaatgaaagagcctgggtcctggtgaaggtctcctggtagggcttcgtggaggcttccttcagcagctacagtgtgacttgggtgcgacaggcccctggacaagggcttgagtggctgggaaagntcatcctgagtacggctagtacgactagcacagaaattccaagggcaagacctcaacgattaccgcggtaacaaatcgaacgagccaccgccttacatacggaaactaagcagccctaggaaagtctagaagaccgacggtccgtatatacgtgtgcgtaggaacgtattcgttgagtggcttcgttnaatcgtgggccagggtacccnggtccaaccgtccc

SEQ ID NO: 328696 - DNA, 615 bp, Homo sapiens
  misc_feature: GZ8MTXP01DGXBP.45.51.E07.1.454.CMB.2.raw
  modified_base (332)..(332): a, c, t, g, unknown or other
  misc_feature (332)..(332): n is a, c, g, or t
  modified_base (382)..(382): a, c, t, g, unknown or other
  misc_feature (382)..(382): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagagcctgggtcctcggtgaaggtctcctgtagggcttctgggaggctccttcagcagctacagtgtgacgttgggtgcgacacggccccgtggacgaagggcttggaggtggcgtaggggaaagtntcatcccgtggacgtacgggctagtacgactacgcacagaaacgttccgngggcagactcgacgattaccgcggaacaaagtcgacgacgcacccgcttcatacggaactaagcacgcctaggggtaacgtcgtaaggaacgacgtaccgggaccgttaattaacgttacgtggtagcggaaggtaagttattcgttagaggttcggtcttaccgttagttaacgtaacgggtacggggaacccgaacggggaacccgttgggttaacccgaacccggttccc

SEQ ID NO: 328697 - DNA, 532 bp, Homo sapiens
  misc_feature: GZ8MTXP01CZPVH.45.51.E07.1.454.CMB.2.raw
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (526)..(526): a, c, t, g, unknown or other
  misc_feature (526)..(526): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctggtagggcttcgtggaggctccttcagcagctacagtgtgacttgggtgcgacgacggcccctggacaagggcttgagtggcgtagggaaagatcatccctgacgtacggctagtacgactacgcacagaaacgttcngggcagactnacgatacgcgacaagtcgacgagcaccgcttcatgaactaagcagcctaggagtctagaagacacggcgtatactntgtgcgagaatnttcgttgngtcggcttaccgttagactaacgtcgggcgacgggacccttggtccnccgtcc

SEQ ID NO: 328698 - DNA, 700 bp, Homo sapiens
  misc_feature: GZ8MTXP01AS8PN.45.51.E07.1.454.CMB.2.raw
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttntggaggcttccttcagcagctacagtgtgacgttgggtgcgacacggcccctggacagggcttgagtggcgtagggaaagntcactccccgtggacgtacgggctaggtacgactacgcacgagaaagttcccgaagggcagactcgacgattaccgacggtaacaaagtccggaacgacgaccgacccgtacccttacgaacgttacggaaaccgttaaacgccgtaacggtaccccgtaaggggtaacgttacccggtaaggaaacggtaacccgaccgggtacccgtttaaatttaacgtttaaccgtgggttacggacggaagggtaagtaacgtttccgtttaggaacggtttccgggactttacccgttaaggttaaaccgttaaccggggttcggggaacccgtaacgggggtaaccccgttgggttaaccccgaacccggtcccccg

SEQ ID NO: 328699 - DNA, 615 bp, Homo sapiens
  misc_feature: GZ8MTXP01ELVQG.45.51.E07.1.454.CMB.2.raw
  modified_base (206)..(206): a, c, t, g, unknown or other
  misc_feature (206)..(206): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (574)..(574): a, c, t, g, unknown or other
  misc_feature (574)..(574): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagcctacttctcctgtacggccagtcagactattaccagcaacttagcctggtatacagacaaaacnggaccagcctcccgctcctcatctgngtcgacacacacgacgcacgtgtactccagtcgtagtcgaggtcggcgaggtggtcggtagggacgtcgggttcctctaccacgtacgtcggacgggtctacgagttcgtagtaagttacgtttgacgtttaagtttactacgttattacctattaccgtaagttactaacgtaacgtacgggacgggttactaacggttcgggtttacggaccggggtaacggaaccgtaagtcggtaggaagtaacgttaacgaaacgttagttcgacggttnttcgactaactatcgttacgtcttactccttccgtaacccg

SEQ ID NO: 328700 - DNA, 523 bp, Homo sapiens
  misc_feature: GZ8MTXP01AW0FP.45.51.E07.1.454.CMB.2.raw
  modified_base (272)..(272): a, c, t, g, unknown or other
  misc_feature (272)..(272): n is a, c, g, or t
  modified_base (322)..(322): a, c, t, g, unknown or other
  misc_feature (322)..(322): n is a, c, g, or t
  modified_base (388)..(388): a, c, t, g, unknown or other
  misc_feature (388)..(388): n is a, c, g, or t
  modified_base (473)..(473): a, c, t, g, unknown or other
  misc_feature (473)..(473): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcgggtgaaggtctccgtgtagggcttctggagctcttcagcagctacagtgngacttgggtgcgacaggcccctggacaagggcttgagtggctagggaaantcatccctgagtacggctagtacgactacgcacagaaacgttccaagggcagactcacgattacgnggacaatcgacgagcacgcttcatggaactagcagcctaggactcagaagacgacgccgtaatacttaacgtgtgcgtaggaatnttcgtgagtgcttacgttgatcgtgggctagggaccttggtcaaccgtcc

SEQ ID NO: 328701 - DNA, 604 bp, Homo sapiens
  misc_feature: GZ8MTXP01BNIOV.45.51.E07.1.454.CMB.2.raw
  modified_base (323)..(323): a, c, t, g, unknown or other
  misc_feature (323)..(323): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctggtctgaaatgaagagcctggtcctggtgaaggtctcctgtaggcttcgtggagctccttcagcagctacgagtgtgacgttgggtgcgacgacggccccgtggacaagggcttgagtggctagggaaagntcatcccgtgacgtacggctagtacgactacgcacagaaacgttccgaagggtcacgactcgaacgattacccgacgaacaaagtccgaacgacgccacccgtccttacgaattacggaaactaaggcaagtcccgtagggaacgtcgtaggaaacgaccgaacgggccgttaattacttacgtgtacgagaggtaagttattcgttgacgtggtcttaccgttagaacgttcggtcggggccgaacgggtaacccgttcggtcccgaacccggttccccg

SEQ ID NO: 328702 - DNA, 634 bp, Homo sapiens
  misc_feature: GZ8MTXP01CJ95F.45.51.E07.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgaggggangccacttcncctgtaggccagtcagactataccagcaacttagcctggtatcaagacaaaaccgtggccaggcctccccggctcctcactctcgtggtcgcacacgaccgagggcccactcggtactccccgagccgtaggtttcacggtggacgtagggttcgggggtcgtacgggggacctcgggggttacccgtcgtaccgacctacgtccggacggggtctacgtacgtctaggtaacgttatttgacttagtttacttacgttgtctacgtntacgtacttacngttccgacggggtctacgttaggtttcggaccggtacggggaaccagtcgtagggaagtacgttacgtaaacgacgttgggacggttcgttcggacctccgtagttccgttggttccttactaactttcccgttaaccccg

SEQ ID NO: 328703 - DNA, 673 bp, Homo sapiens
  misc_feature: GZ8MTXP01A7RBP.45.51.E07.1.454.CMB.2.raw
  modified_base (207)..(207): a, c, t, g, unknown or other
  misc_feature (207)..(207): n is a, c, g, or t
  modified_base (276)..(276): a, c, t, g, unknown or other
  misc_feature (276)..(276): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtcctctgtctccgagggggaanacgcctaccttctcctgtacgggccagtcagactataccagcaacttagcctggtatcagacaaaaccnggccaggcctcccggctcctcactctcgtggtcgcacaccacgacgggccagtggtactcccgagccgagttcaggtggcgtaggtcgggtcgtacgggacgtcgggttcctcgtccgaccaggtcggaacgggtcctaacgtagtccgtaggtaacgttacgtttgaccgttaagttttacttacgtgttactagttacctaagttcgtacctaaggtccgtaacgggggtactaccggttaggttttacgggaaccggtacggggtaaccgtaacgggtccgtagggaaagtaacgttaaaccgtaaaacggttaaccgtgggtacggttccttcgggaccttaaccgtcttaacccgttgtcccgtttactcccggttcccgtttaacccccgg

SEQ ID NO: 328704 - DNA, 684 bp, Homo sapiens
  misc_feature: GZ8MTXP01C9PHP.45.51.E07.1.454.CMB.2.raw
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctagaaatgaagagccgtgggtcctggtgaacggtctccgtggtagggtcttcgtgggagccttccttcagcagctacgagtgtgacgttgggtgacgacgacggccccgtggacgaagggtcttggaggtggacgtagggaaagatacatcccgtaggacggtacgggtctaggtacgacgtacgcaacgaggtaaacgttcgaagggcaacgactacgaacgtacgttaccggacggaacaaacgtcggaacgacgaccaacccggtcttacgagttacggaaacttaagacgacgtccgtagggtaacgttcgtaagaaccgacgaaccgggtacgttaacgttaacgtttacgtggtcggacgggtaaggttaacgttacgttcggttaggaggttacgggtctttaaccgttaggttaacgttaaccgggtacgggggaacccgtaacggggtacccgttcgggtaaccaaccccggttcccg

SEQ ID NO: 328705 - DNA, 532 bp, Homo sapiens
  misc_feature: GZ8MTXP02F32K4.45.51.E07.1.454.CMB.2.raw
  modified_base (206)..(206): a, c, t, g, unknown or other
  misc_feature (206)..(206): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctgtagggccagtcagactataccagcaacttgcctggtatcagcaaaacctggccaggctccccggctcctcatctctggtgcacacaccagggccactggtatcccagccaggttcagtggcagtgggtctgggacnggggttcctctcaccntcgacgggctacgagtctgaagtattttgctagtttattacgtgtacatacagtatcatcgaggggtcacgtaggttttcggccgtaaggggaccaagcgtaggagagttacaaacggtaactggtggcctggcaaccgatctgtcttcactcttcccg

SEQ ID NO: 328706 - DNA, 529 bp, Homo sapiens
  misc_feature: GZ8MTXP02IRZ2Y.45.51.E07.1.454.CMB.2.raw
  modified_base (323)..(323): a, c, t, g, unknown or other
  misc_feature (323)..(323): n is a, c, g, or t
  modified_base (392)..(392): a, c, t, g, unknown or other
  misc_feature (392)..(392): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacacggcccctggacaagggcttgagtggctgggaaagntcatccctgagtacggctagtacgactacgcacagaacgttcagggcagactcacgataccgcgacaancgacgagcaccgctcatcggaactagcagcctagaatctagaacgacacggaccgtatatactgtgcgaggagtatcgttgagtggtctaccgttagactaacgtggggacctacgggacctcggtaccaccgtccc

SEQ ID NO: 328707 - DNA, 535 bp, Homo sapiens
  misc_feature: GZ8MTXP02GMA5R.45.51.E07.1.454.CMB.2.raw
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
  modified_base (458)..(458): a, c, t, g, unknown or other
  misc_feature (458)..(458): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggacaagggcttgagtggctgggaaagntcatccctgagtacggctagtagactacgcacagaagttccnggggcagactcacgattaccgnggacaaatcgacgagcaccgctcatggaactaagcagcctagaagtctagaagacacggccgtatacttacngtagcgaaggattatcttgagtcggctccttaagaataacgtggggaccacggggaaccctgggtaccaccggtccc

SEQ ID NO: 328708 - DNA, 526 bp, Homo sapiens
  misc_feature: GZ8MTXP02JVN63.45.51.E07.1.454.CMB.2.raw
  modified_base (205)..(205): a, c, t, g, unknown or other
  misc_feature (205)..(205): n is a, c, g, or t
  modified_base (360)..(360): a, c, t, g, unknown or other
  misc_feature (360)..(360): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgaggggaanagccaccttctcctgtagggccagtcagactattaccagcaacttagcctggtatcagcaaaacctggccaggctccccggctcctcatctctggtgcacacaccagggccacgtggtactcccagccaggttcagtgcagtgggtctggggacnggggttccgtctcgaccatcgacgggctacgagtctgaatagtttgctagtttattactgtcatcagtatcatcaggggcacgagtttggccgtaggggaccaagcgtaggagatacgaaaacgacgtggtacggctgcaaccgatcgtgtcttcactcttccccg

SEQ ID NO: 328709 - DNA, 527 bp, Homo sapiens
  misc_feature: GZ8MTXP02JU09X.45.51.E07.1.454.CMB.2.raw
  modified_base (321)..(321): a, c, t, g, unknown or other
  misc_feature (321)..(321): n is a, c, g, or t
  modified_base (469)..(469): a, c, t, g, unknown or other
  misc_feature (469)..(469): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgagtgcgacaggcccctggacaagggcttgagtggctgggaaanatcatcctgagtacggctagtagactacgcacagaagttccagggctagacgtcacgataccgacggacaaatcgacgagcaccgcctcatggactaagcagcctgagtctagaagacacggaccgtatatacgtgtgcgaggagtancgttagagtggcttccttaagaacgtacgtggggaccgacgggaccctggtacacccg

SEQ ID NO: 328710 - DNA, 560 bp, Homo sapiens
  misc_feature: GZ8MTXP02IOIP5.45.51.E07.1.454.CMB.2.raw
  modified_base (206)..(206): a, c, t, g, unknown or other
  misc_feature (206)..(206): n is a, c, g, or t
  modified_base (360)..(360): a, c, t, g, unknown or other
  misc_feature (360)..(360): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctgtagggccagtcagactattaccagcaacttgcctggtatcagcaaaacctggccaggcctccccggctcctcatctctggtgcacaccacgagggcccactggtactcccagccaggttcagtgcagtggtctgggacngggggttcctctcacccgatcggacgggtctacagtctgaagtattttgctagtttattactgtcatacagttatcgtatccgagggggtaccacgttaggttttgggccgtaaacgggggacctaaaggcgttagggaacgtactaacgaaacgtaactggtacggctgacaacgatcttgtacttctactccttcccg

SEQ ID NO: 328711 - DNA, 548 bp, Homo sapiens
  misc_feature: GZ8MTXP02I1BXL.45.51.E07.1.454.CMB.2.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctcgagggganagccacttctcctgtaggccagtcagactattaccagcaacttagcctggtatcagacaaaacctggccaggcctccccggctcctcatctctggtncacacaccagggccactggtactccccagccaggttcagtggcagtgggtcnggggacnggggttcctctcaccntcggacgggctacgngtctgaagtatttgactagtttattactgtacatcagttatctatcgaggggtacacgtaggtttcggaccgtaaggggacctaaggcgtagggaagagtaacgaaacggtaaactggtacgctggacaacgtatcgtctcttctacttccttacccg

SEQ ID NO: 328712 - DNA, 559 bp, Homo sapiens
  misc_feature: GZ8MTXP02HVQ0M.45.51.E07.1.454.CMB.2.raw
  modified_base (369)..(369): a, c, t, g, unknown or other
  misc_feature (369)..(369): n is a, c, g, or t
  modified_base (465)..(465): a, c, t, g, unknown or other
  misc_feature (465)..(465): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggaccaagggcttggagtggctagggaaagatcatccctgagtacgggctagtacgactacgcacagaagttccngggcagactcacgattaccgcgaacaaagtcgacgagccacgtccttcatggaactagcagcctgaagtcagaagacacggccgtaatacttacgngtcgcgaggtagtatcgttgagtcggtacctaccgtttaagaacgttaacgtacgggggacccgaacggggaccctacggtccaacccggtccc

SEQ ID NO: 328713 - DNA, 508 bp, Homo sapiens
  misc_feature: GZ8MTXP02GBJU1.45.51.E07.1.454.CMB.2.raw
  modified_base (364)..(364): a, c, t, g, unknown or other
  misc_feature (364)..(364): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggacaagggcttgagtggctgggaaagatcatccctgagtacgggctagtagactacgcacagaagttcnggggcagactcacgattaccgcgacaaatcgacgagcaccgcttcataggaactagcagcctgagtctagaagacacggcctatattactgtgcgagagtatctgagtcgctctagaatgtgggcagggacctggtcaccgtcc

SEQ ID NO: 328714 - DNA, 541 bp, Homo sapiens
  misc_feature: GZ8MTXP02JF9XY.45.51.E07.1.454.CMB.2.raw
  modified_base (285)..(285): a, c, t, g, unknown or other
  misc_feature (285)..(285): n is a, c, g, or t
  modified_base (439)..(439): a, c, t, g, unknown or other
  misc_feature (439)..(439): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagagcctgggtcctcggtgaaggtctcctgtaggcttctggaggctccttcagcagctacagtgtgacttgggtgcgacnggcccctggacaagggcttggagtggctgggaaagatcatccctgagtacggctagtacgactacgcacgagaacgttcaggggcaaggactcacgattaccgcggacaaagtcgacgagcaccgcttcatggaactaagcacgcctagacgtntagaacgacacggactatattactgtgcgaggactagtctggagtcggtcttaccgtagaacgtaagtcggggacctagggacccgtaggaccaccggtccc

SEQ ID NO: 328715 - DNA, 595 bp, Homo sapiens
  misc_feature: GZ8MTXP02H0TKB.45.51.E07.1.454.CMB.2.raw
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacgttgggtgcgacaggcccctggacaagggcttgagtggctgggaaagntcatccctgacgtacggntagtacgactacgcacagacgttccgnggggcagacctcacgataccgcggaacaaagtcgacgacgcacccgtccttacagtaggaactagcaagcctagaacgtcgtagaaacgacgaccggaccgtaattacttacgtggtagcgtaaggtacgttagttcgttaggaggttcggtccttaccgttaaggaaacttaacggtcgggggaacctacgggggtaaccccttcggttacccgacccggtccccg

SEQ ID NO: 328716 - DNA, 627 bp, Homo sapiens
  misc_feature: GZ8MTXP02FRYUK.45.51.E07.1.454.CMB.2.raw
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctctgtagggcttctggaggctccttcagcagctacagtgtgacgttgggtgcgacacggcccctggacaagggcttggagtggcgtgggaagatcatcccgtgagtacgggctagtacgactacgcacagaacgttcgagggcagactcacgtactaccgacggaacaagtcgacgacgcaaccgtccttacagtacggaactaaacgctaacggaccctaggtaaacgttcgtaacggaaaacggaccgaaccggtacccgttaataacgtttaacgtggtacgacggtaaggtaagttactacggtttagaacggtcggtccttaccgttaaggaaacttaacggtacgggggacctaacggggtaacccttcggtacccgaacccggtccccg

SEQ ID NO: 328717 - DNA, 645 bp, Homo sapiens
  misc_feature: GZ8MTXP02GZ3RN.45.51.E07.1.454.CMB.2.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctggtctgaatgaagagcctgggtcctggtgaaggtctcctgtaggcttcgnggagctccttcagcagctacagtgtgacgttgggtncgacgacggcccctaggacgagggtcttaggaggtggcgtaggggaaatcgtcacgtcccgtaggaacggtacgggacttaggtaaccgactacgacaacgagtaacgttccgaggggcagacctacgaacgtaacgttacccgacggaaacaaagtccggaacgacgacccgacccgtcccttacgagttacggaaactaagccgagccgtagacgtcgtaagaacgacacgggtacctattactacgtgtacgacggtaaggtagttacgttcgttacggtaggttcggtaccttaccgttaagaacgttaacgggtacggggaccgtaaacggggtacccttacgggtaccctacccggtcccg

SEQ ID NO: 328718 - DNA, 614 bp, Homo sapiens
  misc_feature: GZ8MTXP02F2TMH.45.51.E07.1.454.CMB.2.raw
  modified_base (453)..(453): a, c, t, g, unknown or other
  misc_feature (453)..(453): n is a, c, g, or t
  modified_base (568)..(568): a, c, t, g, unknown or other
  misc_feature (568)..(568): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggagctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgtacgttgggtgcgacacgggccccctaggaccgaagggctttaggaggttggaccgttagggggaaaagagtccgaattcccccgtaggtacggtacggggtacctaggttacgacctacggacacagtaacgttccgaggggcaagactcgacgtattaccggcgaacaaagtcgacganccgacccgtcgttcagtacggaaactaaacgctaaacgcctaggaacgtctaggaaacgaccgacggccgtaatagttactggtagcggagtagtagttctggtaagtggcctanagttagaagtacgtgggaccgacggtaacccgtggaccctacccgg

SEQ ID NO: 328719 - DNA, 594 bp, Homo sapiens
  misc_feature: GZ8MTXP02JFD6S.45.51.E07.1.454.CMB.2.raw
  modified_base (323)..(323): a, c, t, g, unknown or other
  misc_feature (323)..(323): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttcgtggaggctccttcagcagctacagtgtgacttgggtgcgacaggcccctggacaagggcttgagtggctgggaaagntcatccctgagtacgggctagacgactacgcacagaacgttccaggggcaggactacgacgtacttaccgcggaacaaaacgtcgaaccgagccgaacccgcctttaccagttacggaaactaaacggcaacgccctaggtaacggttcctaagaacggaaccacgggtacccgtaattaacgttaacgtgtgacgaggtagtactcgttggagtcggtcttaccttagaactaacgtggggaccacggggtaaccctggtccacggtccc

SEQ ID NO: 328720 - DNA, 628 bp, Homo sapiens
  misc_feature: GZ8MTXP02IQI4M.45.51.E07.1.454.CMB.2.raw
  modified_base (397)..(397): a, c, t, g, unknown or other
  misc_feature (397)..(397): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctccgtgtagggcttcgtggaggctccttcagcagctacagtgtgacgttgggtgacgacgacggcccctggacgaagggtcgtttggaggtcggcgttaggggaaaagatccacttcccgtaggacgtacgggctaggtacgacctacgcacaagtaacgttccgnggggcagactcacgactaccgacggaacaaagcgacgacgccacccgtcttacagtaggaaactagcacgcctaggaaacgttcgtaagaacggtaaccgaaccgggtcccgtaagttacttacgttagtcgacggagtaacgttagttacgttcggagttcggtacttaccgttaagtaacgtaacggtcggggaccgtaacgggtaacccctggtacccacccggtccc

SEQ ID NO: 328721 - DNA, 580 bp, Homo sapiens
  misc_feature: GZ8MTXP02F6VNQ.45.51.E07.1.454.CMB.2.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacgttgggtgcgacgacggcccctggacgaaggcttgagtggctagggaaagntcatccctggagtacggctagtacgactacgcacagaacgttccgnggggcagactacgacgtaacgttaccgacggaacaaacgtccggaacgacgaccacccgtaccttacgagtacggaactaagcaacgcctagacgtctagaacgacgacggcctagtacttacgtgtgcgaggtagtatcgttagagtcgctacgtattaagaacgtacgtacggggaccgtaacgggtacccgtcggacctacccgg

SEQ ID NO: 328722 - DNA, 563 bp, Homo sapiens
  misc_feature: GZ8MTXP02FT7QB.45.51.E07.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (365)..(365): a, c, t, g, unknown or other
  misc_feature (365)..(365): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctcgaggggangccacttcncctgtagggccagtcagactattaccagcaacttgcctggtatcagacaaaacctggccaggcctccccggctcctcatctctggtcgacacacaccgagggccacgtggactcccagccagttcagtgcagtgggtctgggactcggggtcnctcgaccagtcggcgggtactacgacgtctagaaattgttttgacttacgtttattacgtgtacattacgtagtactcgtagtcgtaaggggataccggtggtttacggaccgaaggggtaccaggcgtagggaactagacgaaacgtacgtcggtcggctacgaccaacgtactcgtctctctaccgttcttacccg

SEQ ID NO: 328723 - DNA, 561 bp, Homo sapiens
  misc_feature: GZ8MTXP02JCH59.45.51.E07.1.454.CMB.2.raw
  modified_base (368)..(368): a, c, t, g, unknown or other
  misc_feature (368)..(368): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaatgaagagcctgggtcctcggtgaaggtctccgtgtagggcttcgtggaggctccttcagcagctacagtgtgacttgggtgcgacaggccccctggacaaggcttgagtggctgggaaagagtcatccctgagtacgggctagtagactacgcacgagaacgttccnggggcaggactaccacgattaccgcggaacaaatccgagagcacgcttcactggacaagcagcctagaacgttcagagaacgcggaccgtatacgttactgtagcgaggacgtagtcttggagtcggtcttacccgttaagaaacttaacggtcggggaccgacggggaacccttagggtccaccggtacccc

SEQ ID NO: 328724 - DNA, 608 bp, Homo sapiens
  misc_feature: GZ8MTXP02JFK1M.45.51.E07.1.454.CMB.2.raw
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (541)..(541): a, c, t, g, unknown or other
  misc_feature (541)..(541): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttnagcagctacagtgtgacttgggtgcgacacggcccctggaccaagggcttgagtggcgtgggaaagntcagtccctaggacgtacggggctagacgacgtacgcacagtaacgttccgaggggccaggtactcgacgtagtttaccgcggaacaaaagtccggaacgaacggcctaacccggccttacagtacgggtaaactaaacggcaaacggcctaggaacggttctaggaagacgacgggacctattacgtactggtgacgaggtacgtagtcgttagngttacggtctaccgttagaagtaacgtggggaccgacggggtaacccttcgggtaccacggtccccg

SEQ ID NO: 328725 - DNA, 720 bp, Homo sapiens
  misc_feature: GZ8MTXP02JD009.45.51.E07.1.454.CMB.2.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
tcagacgcgatcgacacgaccggtgctcgatttagcatactctacaacacacaaagggggaggaactgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctggtacgggccagtcagactattacccagcaacttagcctggtatcagcaaaactgcagctccccgctcctcntctctggtcgcacacaccgagggccacgtggtactcccagcctaggttcacggtggccgaggtcggggtcgtggggactcgggggttcccgtcgtccgacccgtagtaccgggtaaccggggcttaaccgacgttaccgttaggtaaacgttagtttttacgtactttaaggttttaacgtttacgttacgtaccgtattacgtaagtttaactacgtaacgttacggaacgggggtacctaacggtttagggttttaccgggacccgggttaaacgggggaacccctaagggtaccgtagggtaaaacggtaacttaaaaccggaaaaaccgggtacgttacgggtaacgggtccgttaccggaccgtaacccgtacgttaccgttaccggtttcctttaccgttaacctttaccccgtttcccccg

SEQ ID NO: 328726 - DNA, 727 bp, Homo sapiens
  misc_feature: GZ8MTXP02HYJZO.45.51.E07.1.454.CMB.2.raw
  modified_base (263)..(263): a, c, t, g, unknown or other
  misc_feature (263)..(263): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcgggtagaaggtctcctggtaggcttcgtggacggtctccttnagtcagctacagtgtgacgttgggtgcgacacggcccctggacgaagggtcgttgaggtggcgtagggaaagatcatcccgtggacggtacggctagtacgactaccgacacgtagtacgttaccgacggggcaacggtacctcgtaacgaactttacccgggacggaaacaaaacgtacccggacgacgacccgaacccggtacccctttacacggttaacggaaacccttaaacgacaaaccggtcccgtaaggtaaacgttaccgtagggaaccgtaaccggaacccggtcccggttaaatttaccggttacgttaggtaccggtacgtaaggggtaaggttacgtttacggttagtacggttacggttccttaaccgttaaggtaacgttaaccggtacgggggtaacccgtaccgggggtaaccccgttaccggggtaacctacccccgggtttacccc

SEQ ID NO: 328727 - DNA, 672 bp, Homo sapiens
  misc_feature: GZ8MTXP02FJRE9.45.51.E07.1.454.CMB.2.raw
  modified_base (605)..(605): a, c, t, g, unknown or other
  misc_feature (605)..(605): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatcgtgggtctgaaatgaagaagccgtgggtcctggtgaaggtctccgtggtagggtcttcgtggagtccttccttcagcagctacgagtgtgtacgttgggtcgacgacgacggccccgtaggacgaagggtcgtaggaggtggacgtagggaaagtatacgtacgtccgtaggaacggtacggtacgtaaggtacgtaccgtacgacgaacgaacgtaacggggggttccaggggcaacgtacctaccgaacgtaacgtaccggacgtaaacgaaacgtaccggaacgacgaccgacccgtccgtacgaacgtacgaaacgtaacgacgacgtaccgtagtaacgtcgtaaggaacgacgtaccggtacgtattaacgttacgtgtacgacgaaggtacgttacgttgttacggngtacgtacttacgtaagtaacgtaacggtacgggaccgacgggtaccgtcggtaccgtaccgtcccg

SEQ ID NO: 328728 - DNA, 632 bp, Homo sapiens
  misc_feature: GZ8MTXP02IDYYG.45.51.E07.1.454.CMB.2.raw
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
tcagacgcgatcgacacgaccggtgctcgatttagcatactctacaacacacaaaggggacgttacaaccacattcctcctctaaagaagccctgggagaacagctcatcaccatggactggacctggaggctctctttgtggtggcagcagctacaggcggccagtcccaggtccagttggtgcaatctgggtctgaaagtgaagaagcctgggtcctcggtgaaggtctccgtgtagggcttcgtggagctcttcagcagctcagtgtgacttggggtcncgacgcggcccgtaggacgaggtcgttggaggtggacgtagggaaatctacgactccgtagacggtacggctagacgactacgcacgagtacgtccgngggcacgaccgtacgacgtacgtaccgacgtaaacaaacgtcgaacgacgtaccacccgtacttacgaagtaacggaaactacgaccgaacgtccgttagaacgttgacggaacgacgacggtacgttaactagttacgttgtacggtaggtaagtacgttacgttcgttacggtacggttacggtccgttacgttaagtaacgtcggaccggggtacgaaccgggtaccgtccggtaccgtacccgtcccg

SEQ ID NO: 328729 - DNA, 762 bp, Homo sapiens
  misc_feature: GZ8MTXP02I7GIZ.45.51.E07.1.454.CMB.2.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
tcagacgcgatcgacacgaccggtgctcgatttagcatactctacaacacacaaaggggacgttacaaccacattcctcctctaaagaagcccctgggagaacagctcatcaccatggactggacctggaggctcctctttgtggtggcagcagctacaggcggccagtcccaggtccagttggtgcaatcgtgggtctagaaatgaagaagccgtgggtcctggtgaagtctccgtgtaggcttcgnggagtcttcctnagcagcctanagtgtgtacgttggggtgaccgacgaccgggcccctagggaacgtaacggggntttcgggaggttgggacgttaggggaaaagtcttccacgttccccgtaggtaacggtaccggggagttagtaccggtaaccaccggacgaacgaaggttacccgttacgggacggggtctaaaccgggtacgtacccgaacggttaccgttaaacccgggacgtaaaccgtaaacgtcccgaacgaccgtaccgaacccccggtactttaccgaacggtacgttaaaacgacaccgaagtaccccgttacggtaaaagtttccgaagaacggaaacccgtcggggttaacgttaactttaaagttcccgggttggtaccgtaaacgggttacgttaacggtccgtttaacttggggtaacgttggtaccccttagttaaacgtaacggttcccgtagggggaccttaaccgggggacctttcggacccggtactccccg

SEQ ID NO: 328730 - DNA, 433 bp, Homo sapiens
  misc_feature: GZ8MTXP01AWM7J.44.46.E02.1.454.CMB.2.raw
  modified_base (428)..(433): a, c, t, g, unknown or other
  misc_feature (428)..(433): n is a, c, g, or t
tcagacagtatatacacgaccggtgctcgatttagactcatctacagggaaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactacgtggggccgggaaccctggtcaccgtctcctcagcctccaccaaggcccatcggtcttccccctggccgccctgcctccaggagcacctccgagagcaccagcggccctggggctgccctggtcaaagggctacttccatatactgtctggagcgggctggcaaggcgcatagnnnnnn

SEQ ID NO: 328731 - DNA, 484 bp, Homo sapiens
  misc_feature: GZ8MTXP01CVHI5.44.46.E02.1.454.CMB.2.raw
  modified_base (338)..(338): a, c, t, g, unknown or other
  misc_feature (338)..(338): n is a, c, g, or t
  modified_base (473)..(473): a, c, t, g, unknown or other
  misc_feature (473)..(473): n is a, c, g, or t
  modified_base (476)..(484): a, c, t, g, unknown or other
  misc_feature (476)..(484): n is a, c, g, or t
tcagacagtatatacacgaccggtgctcgatttagactcatctacagggaaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacgttggtcagtggtcttggttttgactacggtgggggcccgggggtaaccctggtcacccgtctccctcacgcctcccaccgaacgggccccattccggtccttcccccngggcccgcccctgcctccgagggacgccaccctccgagcgccaccgacggccggccctggggctcggccgtggtaccaaacgggtaccttactcctaatactactgtctggagcgggctagggcaacggcgacanagnnnnnnnnn

SEQ ID NO: 328732 - DNA, 477 bp, Homo sapiens
  misc_feature: GZ8MTXP01CBD7H.44.46.E02.1.454.CMB.2.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
  modified_base (456)..(477): a, c, t, g, unknown or other
  misc_feature (456)..(477): n is a, c, g, or t
tcagacagtatatacacgaccggtgctcgatttagactcatctacagggaaaggggctggagtgggttggccgtattagaaccaaagctgacggtgggacagcagactacgctgccacccgtgaaaggcagattcaccatctcaagagatgattacaaaagatacggtgtctctgcagatgaacagcctagaacaccgagacacagccgtatattactgtctgggattggttnagttcgggacacggacctgtccacgctccnacgcctccaccgaaggcccctagtccgttcctccccccgtggcccgtcccctggcccctcgaggccacctaccgacgagaccgccacggccgcccgtacggcggtcgtccgcgttacggaatacccgtaccttaacgttactaattcgtacgttcgtacgagggcgggacgtcgacggacaacgggcaggtannnnnnnnnnnnnnnnnnnnnn

SEQ ID NO: 328733 - DNA, 460 bp, Homo sapiens
  misc_feature: GZ8MTXP02GSPGA.44.46.E02.1.454.CMB.2.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (447)..(460): a, c, t, g, unknown or other
  misc_feature (447)..(460): n is a, c, g, or t
tcagacagtatatacacgaccggtgctcgatttagactcatctacagggaaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactacgtggggccggggaaccctggtcaccgtctcctcagcctccaccaaggccccatcggtcttcccccgngccncctgctcgaggcnccaccncgagacgcaccgacgccgcccgtgggctcgccgtggtacaaggtaccttaccttcctaatactactgtctggacgcgggctgggacaacgggcgacaagtagnnnnnnnnnnnnnn

SEQ ID NO: 328734 - DNA, 436 bp, Homo sapiens
  misc_feature: GZ8MTXP02IM798.44.46.E02.1.454.CMB.2.raw
  modified_base (323)..(323): a, c, t, g, unknown or other
  misc_feature (323)..(323): n is a, c, g, or t
  modified_base (433)..(436): a, c, t, g, unknown or other
  misc_feature (433)..(436): n is a, c, g, or t
tcagacagtatatacacgaccggtgctcgatttagactcatctacagggaaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggtttgactactggggccgggaaccctggtcaccgtctcctcagcctccaccaagggccccatcggtcttccccctggccncccctgctccaggacgccaccctccgagagcaccagccggccctggggctgcctgggtcaaggacctacttcctatatactgtctgagcgggctggcaagggcgcatagnnnn

SEQ ID NO: 328735 - DNA, 498 bp, Homo sapiens
  misc_feature: GZ8MTXP01ANNOM.51.76.G10.1.454.CMB.2.raw
  modified_base (194)..(194): a, c, t, g, unknown or other
  misc_feature (194)..(194): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccaggggaanagccacctctcctgcagggccagtcagagtgttagcagcgacttagcctggtaccagcagaacctggccaggctccaggctcctcatctatgatgcatccacaagggcccactgatatcccagccaggttcaggtggcaggtgggtctggggacagagttcactctcaccatcagcagcctgcagtctagaagtatttgactaatttagttactgtcagcagtaataataactggtcctcgtactctttggccgttaggggaccagtcgtaggagattacgaaacgacgtgtgcttgcncctaa

SEQ ID NO: 328736 - DNA, 602 bp, Homo sapiens
  misc_feature: GZ8MTXP01ESN6T.51.76.G10.1.454.CMB.2.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (524)..(524): a, c, t, g, unknown or other
  misc_feature (524)..(524): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttccncgttagctcttttaagaggtgtccagtgtcaggtgcagctggtggagtntgggggnggcgtgtcgacgccggcggtccgtgagactctctgtgcngctctgtatctactcagtgctagtgnatgcacgtcggtccgccgacgcgtccgacggacggaagggcggtggtagggtgggtggtacgttatttatatacgtagagtagtagtagtacgtaaaagtaaagtaaagtaagtaagtagtacgtacgtacgtacggtacggtaacgggtacgtactactacctactactaccgacgaacgtaactaacttaaccaacgaaacaactacgtagtactactacgaactaaagtaagaacgaagtagtagagagngtaagaggacgtacgttcgtgttgttagttcgttgtaagtacgtaacgtagtagttaggtaagggttaagggtaaggg

SEQ ID NO: 328737 - DNA, 608 bp, Homo sapiens
  misc_feature: GZ8MTXP01BVCZU.51.76.G10.1.454.CMB.2.raw
  modified_base (264)..(264): a, c, t, g, unknown or other
  misc_feature (264)..(264): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccaggcccgggagtccctgagactctcctgtgcagcctctggattcaccttnagtcgcctagtgcatcgctacgtcggtcccgccgacggcctaccgaggacggaaggggtcgtagggaggtgggtgactattatatacgtacgtagtagtagtagagtaaagtaaagtaagtaagtaagtagtacgtacgtacgtacggtacggtaacggtaccgtacgtactacctactactaccgaacgaacgaacaacctaccaacgaaactaactaacgtacgtactactacgaactaaagtaagaacgaagtaagtagagagagtaagacggacgtacgcgtgtgttagttcgttcgtaagtacgtaacgtacgtagttaggtaaggttaagggtaaggg

SEQ ID NO: 328738 - DNA, 611 bp, Homo sapiens
  misc_feature: GZ8MTXP01A8204.51.76.G10.1.454.CMB.2.raw
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (522)..(522): a, c, t, g, unknown or other
  misc_feature (522)..(522): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcgtcgtaggctctttaagaggtgtccagtgtcaggtgcagctggtggagtcgtgggggagcgtggtccaggcccgggaggtccctgagactctcctgtgcagctctgatcacttcagtgcctatggcatgcnctggtccgccacggcnccgaggccgaagggggcggtggtagggtgggtggtgtattatatacgacgagtagtagtgacgtaaagtaaagtaagtaagtagtacgtacgtacgtcgtacggtacgggtaacgggtaccgtacgtacctacctactactaccgacgaacgaactaacctaccaacgaacaactacgtacgtacgtacgtacgaactaaagtaagaacgtaagtagtagaagacgngtaaggaacggacggtacggttacgtgttagttacgttcgttacggtaagtacgtaacgtagtagttaggtaagggttaagggtaaggg

SEQ ID NO: 328739 - DNA, 570 bp, Homo sapiens
  misc_feature: GZ8MTXP01C6Z8Z.51.76.G10.1.454.CMB.2.raw
  modified_base (374)..(374): a, c, t, g, unknown or other
  misc_feature (374)..(374): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactattggattggcacctgcagaagccaggggcagtctccacaggtcctgatcttatttgacgttctaacgtccccgggcccccgggtctgacaggttcagtggcagtgatcaggcacagtatttanactagaaatcagcaggagtggagcgtagaggtaggttggtttgggggtttaatcgtagtttggctagttagactaaagtcttacctaaacaaaccttcccttagttacggttaccgttttacggggcgggttaacggggttacccgttaaaggggttgggaagaacgttacgaagaccggtaacgttggtaacggg

SEQ ID NO: 328740 - DNA, 515 bp, Homo sapiens
  misc_feature: GZ8MTXP01DROX1.51.76.G10.1.454.CMB.2.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctctgcatagtattggatacatattggattggcactgcagaagccagggcagtctcanaggtcctgatctatttgagttcaagtccccggggcccccgggtctgactaggttcagtggcaggtggatcagggcacagtattttanactagaaaatcaagcaagagtggagntggaggtagttggtttggggtttancgtattgcagtgctaagctctaacaaacttcttacgtagttacgtttcgggaggttacgggccaagggtgagaactcgaagccgtaagttgtgg

SEQ ID NO: 328741 - DNA, 606 bp, Homo sapiens
  misc_feature: GZ8MTXP01EKQ50.51.76.G10.1.454.CMB.2.raw
  modified_base (291)..(291): a, c, t, g, unknown or other
  misc_feature (291)..(291): n is a, c, g, or t
  modified_base (332)..(332): a, c, t, g, unknown or other
  misc_feature (332)..(332): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccaggcccgggaggtccctgagactctcctgtgcagcctctggattcaccttcagtgcctatggcatgcacgtgggtccnccaggctccgaggcaagggggctggagtgggtgctatttanatcagatgagtgacgtaaagtaaagtaagtaagtagtagacgtacgtcgtaccggtacgggtacgggtaccgtacttactacctactacctaccgacgaacgaacaactacccaacgaaacaacctaacgttacgtactactacgtaactaaagtaagaacgaagtaagtaggtaagacgcgtaaggaacggacggacggttacgttagttagttagtttcgttaggtaaggtacggtaacgtacgtagttaggtaagggttaaggggtaaggg

SEQ ID NO: 328742 - DNA, 522 bp, Homo sapiens
  misc_feature: GZ8MTXP01ACGT7.51.76.G10.1.454.CMB.2.raw
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccccgggaggtccctgagactctcctgtgcagcctctggattcaccttcagtgcctatggcatgcacgtgggtccnccaggctccgaggcaagggggctggagtgggtgctatttanatcagatgatggacaaagtaataagngtatgcagtctcgtagacgggcattcacatcacaganacaacttccaagacacactgtatctagactaaanagaagagagtagagagngaagaggacgacgttcgtgttgttagttcgttgtgtacgaacgtacgtagttaggtaaggttgggtaaggg

SEQ ID NO: 328743 - DNA, 603 bp, Homo sapiens
  misc_feature: GZ8MTXP01BIPQ5.51.76.G10.1.454.CMB.2.raw
  modified_base (250)..(250): a, c, t, g, unknown or other
  misc_feature (250)..(250): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagagcctcctgcatagtatgatacaatnttgattgcacctgcagaagccagggcagtctccacaggtcctgatctattgagttcaacgtccccgggccccggtctgacaggtcagtgcagtggatcgaggcacagtatttaatacgtagaaaatcgagacaaggaggtgggaaggtcgtaggtagggtaggttggggtttacgggggttttaatacgtaagttggactagtggtacctaaagtccttactaaacctaaaaccttcccgttaccgttaaaggttacccggttttaccggggaacggggttacgggaaacccggttaaagggttaagggaacggtaagtaaccggaaagggaccgtaaccggttgggtccggg

SEQ ID NO: 328744 - DNA, 540 bp, Homo sapiens
  misc_feature: GZ8MTXP01BYCTM.51.76.G10.1.454.CMB.2.raw
  modified_base (198)..(198): a, c, t, g, unknown or other
  misc_feature (198)..(198): n is a, c, g, or t
  modified_base (540)..(540): a, c, t, g, unknown or other
  misc_feature (540)..(540): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgtagcagcgattagcctggtaccagcagaacctggccaggctcccaggctcctcatctatgatgcactccacgaacggccactgactactccccagcctaggttccaggtggcgtaggtggggtctggggactagggtagtttccacttctacaccatcagcagcctgctagtctagaagtatttgtacttaatttattacttgtactagtactaagtaataataacgtcggtaccctaccgtactacgtttcggccgaggggtaccagtcgtaggagacttacaaacgactggtagcttacgcgaacgtn

SEQ ID NO: 328745 - DNA, 536 bp, Homo sapiens
  misc_feature: GZ8MTXP01CFUYI.51.76.G10.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (459)..(459): a, c, t, g, unknown or other
  misc_feature (459)..(459): n is a, c, g, or t
  modified_base (509)..(509): a, c, t, g, unknown or other
  misc_feature (509)..(509): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccnccaggctccgaggcaagggggctgggagtgggtgctatttanatcagatgatggacaaagtaaanaagagtatgcagtctcgtgaacgggccatcactatctacagagacaacttcccaagaacacactgtatctagacaaagtgaaacagtattggaagacgntaaggaaggacacgggttgtgttgttagttcgttggtaagacgtaacgtntaggttaggtaagggttggggtaaggg

SEQ ID NO: 328746 - DNA, 574 bp, Homo sapiens
  misc_feature: GZ8MTXP01CHCTP.51.76.G10.1.454.CMB.2.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggaccagcagaacctggccaggctcccaggctcctcatctatgatgcatccagaagggcccactgatacncccagccaggttcaggtgcaggtgggtctgggacagtagttcactctacaccatcagcagcctgcagtctagaagtatttgactaatttacttacttgtacagtactagtaataagtaacgtcggtacccttaccggttacttaccgttttcgggacccgttaacgggggtaacccaaggtccgttaggggaacgttacgttaaccgaaaaccggtaaacgttcggttacgggcttacggtaaccgttaaccgttaacg

SEQ ID NO: 328747 - DNA, 525 bp, Homo sapiens
  misc_feature: GZ8MTXP01E4D6Q.51.76.G10.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggaggtccctgagactctcctgtgcagcctctggattcacttcagtgcctatggcatgcacgtgggtcccncaggctccgaggcaagggggctgggagtgggtgctatttanatcagatgagtggataaaagtaaataagngtangactagtctacgagacggcatcacatcacagacacactaccaagaacacacgtgtatcagaactaaanagaanagagtagagagngaagagacgacgngtgtgttagttcgttgtaagacgaacgtacgtagttaggtaagggttaaggggtaaggg

SEQ ID NO: 328748 - DNA, 543 bp, Homo sapiens
  misc_feature: GZ8MTXP01D2OUB.51.76.G10.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccacctctcctgcagggccagtcagagtgttagcagcgacttagccctggtaccagcagaaacctggccaggctcccaggctcctnatctatgatgcatccacaaggcccatgatacncccagccaggttcagtgcaggtgggtctggggacaggtagttcactctcaccatcagcagcctgacagtctaggaatatttgacttaattttagttactgttcagtntaagtataaataactcggtccttacgtactctttcgggaccgttagggggacccaaaggccgtaggggaagacttaacggaaaacccgtaagttggagggcccttaggcgaacccgttaag

SEQ ID NO: 328749 - DNA, 621 bp, Homo sapiens
  misc_feature: GZ8MTXP01EBFPB.51.76.G10.1.454.CMB.2.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttcgcgtaggctctttaagaggtgtcagtgtcaggtgcagctggtggagtcgtgggggagcgtggtccagcccgggagtccctgagctctcctgtgcagcctctggnttcaccttcagtgcctatgcatgcngcgcgcncgcncgagngaggngnggnggtggtgtgtattatactagagagtgtagtagagtaagtaaagtaaagtagtagtagtacgtacgtacgtacggtacggtaacgggtaccgtacgtacctaccgtactacctaccgaacgaacgtaaccgtaaacctaacccgaaaccgaaaccgtaactaacgttacgttacgtacgtacgtaacgtaaacgtaacgtaaacgtaagtaagtagaggaacgtacgttaggtacggacggtacggtacgttaggttgtttacgtttcgttggtaacggtaacggtaacgttacgttaacggttaagggtaagggg

SEQ ID NO: 328750 - DNA, 555 bp, Homo sapiens
  misc_feature: GZ8MTXP01BD8UD.51.76.G10.1.454.CMB.2.raw
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
  modified_base (481)..(481): a, c, t, g, unknown or other
  misc_feature (481)..(481): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttnagtgcctatggcatgcactgggtccnccaggctccaggcaagggggctggagtggggtgctagtttanatcagtatgagtcggactaaaagtaaataagagtatcgacacggtccgtacggaggacggactatacactatacacgagacactaactaccgaanaactactacgtagtactctacgaaactaaagtaagaacgaagtagtagagagngtaaggacggacgacgcgtgtgttagttcgttcgtaagacgaacgtacgtagttagtaaggttaagggtaaggg

SEQ ID NO: 328751 - DNA, 567 bp, Homo sapiens
  misc_feature: GZ8MTXP01BQ3OS.51.76.G10.1.454.CMB.2.raw
  modified_base (196)..(196): a, c, t, g, unknown or other
  misc_feature (196)..(196): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgattagcctggtaccagcagaacctggccaggctcccaggctcctcatctatgatgcatccacagggcccactgatancccagcctaggttcagtggcaggtgggtctggggacagagttcactctcaccatcagcagctgcagtctagagtatttgactaatttattactgttcagtcagttataataaacgtcggtcccttaccgtacttaccgttttcgggacccgaagggggtaacccaaggtccgttagggggaacgttacttaaccggaaaaccggtaaacgttcgggtacgggtccgttacggaacccgttaaccccgttaacg

SEQ ID NO: 328752 - DNA, 521 bp, Homo sapiens
  misc_feature: GZ8MTXP01BHHGQ.51.76.G10.1.454.CMB.2.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctntcctgcagggccagtcagagtgtagcagcgacttagcctggtaccagcagaacctggccaggctccaggctctcatctatgatgcatccanaaggccaactgatactccagcctaggttcagtgcagtgggtctggggacaggattcactctcaccatcagcagcctgcagtctgaagtatttgactaatttattactgttcagtcagtataaataactcggtcctacgtactcgtttggccttagggggaccaagtccgttaggaacgttaaacttacgtaaacgtacgtggtacggcgttacgtccgaacgtaag

SEQ ID NO: 328753 - DNA, 574 bp, Homo sapiens
  misc_feature: GZ8MTXP01D3EFQ.51.76.G10.1.454.CMB.2.raw
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtcgcctatggcatgcacgtgggtcccncaggcctccgaggcgaagggggctgggagtggggtgctatttanatcagatgagtggactaaagtaaataagatatgctagtcgtcgtaggaacgggcctattccacctatcctaccaagacgaactaacttaccccaagaaaccaccacttagttactccgtagaacaaatgaaacaagtgtaggaagngcgtaaggaacgcaccgggttgttaggttgttagtttcgagtaacgtaacgtaacgtgtaggttagggtaaggggttggggtaaggg

SEQ ID NO: 328754 - DNA, 530 bp, Homo sapiens
  misc_feature: GZ8MTXP01EDHNK.51.76.G10.1.454.CMB.2.raw
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactattggattggcacctgcagaagccagggcagtctccanggtcctgatctatttgagttctaacgtccccgggcccccgggtcctgacaggttcagtggcagtggatcaggcanagtatttanactagaaatcagacagagtggagngtagaggtagttggtttaggggttatcgtattgntagtgctaagtctactaacaaacttccttagttacgttaacgtttcggggcggttaacggggaccgaagggtggagaatcgaagaccgtaacgttggtgg

SEQ ID NO: 328755 - DNA, 499 bp, Homo sapiens
  misc_feature: GZ8MTXP01CEXS6.51.76.G10.1.454.CMB.2.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgattagcctggaccagcagaacctggccaggctcccaggctcctcatctatgatgcatccanaagggccatgatatcccagccaaggttcagtggcaggtgggctgggacaggagttcactctcaccatcagcagcctgcagtcngaatattttgactaatttattactgttcagactagtaataataactacgtcctccgtactacttcgtcgacggaccgagacgtgagattacaacgaacgtaagtgcgttctcgcgtaac

SEQ ID NO: 328756 - DNA, 566 bp, Homo sapiens
  misc_feature: GZ8MTXP01ECJ3M.51.76.G10.1.454.CMB.2.raw
  modified_base (255)..(255): a, c, t, g, unknown or other
  misc_feature (255)..(255): n is a, c, g, or t
  modified_base (470)..(470): a, c, t, g, unknown or other
  misc_feature (470)..(470): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctctgtgcagcctntggacttcaccttcagtcgccttagtggcatcggcctacgtcggggtccccgccagggcctccgaagggccgaagggggcttggggagtggggtgctattttacactcgagtatgatgggactaagtaaataaaggagtatggacagtcctcgtagaacgggccgattccacctatctaccagagaacaactacccaagaaccactactagtacnctagactaaatacgaaacagtaattggaagaagcgttaggaggacgacgggtcttgttgttactttctgtcgacgtaacgcgtaagttggtaaggg

SEQ ID NO: 328757 - DNA, 723 bp, Homo sapiens
  misc_feature: GZ8MTXP01AFCOV.51.76.G10.1.454.CMB.2.raw
  modified_base (151)..(151): a, c, t, g, unknown or other
  misc_feature (151)..(151): n is a, c, g, or t
  modified_base (266)..(266): a, c, t, g, unknown or other
  misc_feature (266)..(266): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtggtttccncgttgctctttaagaggtgtccagtgtcaggtgcagctggtggagtcgtgggggagcgtggtccaggcccgggagtccctgagactctcctgtgcagcctctggattcacccttnagtcgcctagtggactagtcgccaccggtcggggtccccgccgacggtccctaccggagggacggaagggggtcgtagggggtagggttgggggtcgtacttaagttttatatcgaaggtatggaagtacgggaactaaaaaaggttaaaacgtaaaggtagtacgtacggacgtacgggttccgtaccgggtagggaaccgggtacccgtaacttaccaacctacgtacccgtaaccgaaagaaccgtaacctaaaccgttacccgaaagtaaaccctaactacggttacgtaacttaccgtaacgaaacctaaagtaacgaaacgtaagtaagtaggtaagacggacgtaacggaacggaccggtacggttacgttacgttacgtttacgtttcgttacggtaacggtacggtaacggtacgtacggttagggtaagggttaaggggttaagggg

SEQ ID NO: 328758 - DNA, 504 bp, Homo sapiens
  misc_feature: GZ8MTXP01A8N57.51.76.G10.1.454.CMB.2.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggaccagcagaacctggccaggctccaggctcctcatctatgatgcatccanaagggccactgatatcccagccaggttcaggtggcaggtgggtctgggacagagttcactctcaccatcagcagcctgacagtctagaagtatttgactaatttagttactgtcagcagtataataacgtggccttcgtactacgtttggcccgttaggggacccaaggcctgggagattacaaagacttgnggcttgcaacgtn

SEQ ID NO: 328759 - DNA, 539 bp, Homo sapiens
  misc_feature: GZ8MTXP01BK0SA.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcagaacctggccaggctcccaggctcctcatctatgatgcatccacaagggcccactgatactcccagccaggttcagtggcagtgggtctggggacagagttcactctcaccatcagcagcctgcagtctagaagtatttgactaatttagttactgtacagctaagtataaataactggtcccttaccggtactacgttttcggaccgttagggggacccaaggtcgtagggaattacttacgaaaacggtaactggttcgggacttcggaaccttaacccgtaa

SEQ ID NO: 328760 - DNA, 525 bp, Homo sapiens
  misc_feature: GZ8MTXP01EEJFL.51.76.G10.1.454.CMB.2.raw
  modified_base (345)..(345): a, c, t, g, unknown or other
  misc_feature (345)..(345): n is a, c, g, or t
  modified_base (416)..(416): a, c, t, g, unknown or other
  misc_feature (416)..(416): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagctctcctgtgcagcctctggattcaccttcagtgcctatggcatgcacgtgggtcccgccaggcctccgaggcgaagggggctgggagtgggtgctatttatatcagntgatgggacaaggtaaataaagagtatgctagtctcgtgaacgggcatcacatctcagagacattacccanaacacactgtatctgacaaatagaactagattgagaagcgttaggacggacgacgggtcgttagttgttatttcgtgtaacggacgtaaacgcttaagttggtaagggg

SEQ ID NO: 328761 - DNA, 541 bp, Homo sapiens
  misc_feature: GZ8MTXP01DT45P.51.76.G10.1.454.CMB.2.raw
  modified_base (198)..(198): a, c, t, g, unknown or other
  misc_feature (198)..(198): n is a, c, g, or t
  modified_base (318)..(318): a, c, t, g, unknown or other
  misc_feature (318)..(318): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtctccgaggggaaangcccaccctctcctgcagggccagtcagagtgttagcagcgacttagcctggtaccagcagaaacctggccaggctcccaggctcctcatctatgatgcatccagaaggcccatgatacncccagcctaggttcagtggctaggtgggtctggggacaggtacgttcactctcacatcagcagcctgacagtctagaagttatttgacttaatttattacgttgtacagtctaagttataaactaactcggtacccttaccgtactcgtttgggaccgttaggggaaccaaggtcgtagggaacacgttacgaaacgtacgtggtcggcttgccaaccgtaag

SEQ ID NO: 328762 - DNA, 519 bp, Homo sapiens
  misc_feature: GZ8MTXP01AOO0Z.51.76.G10.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (399)..(399): a, c, t, g, unknown or other
  misc_feature (399)..(399): n is a, c, g, or t
  modified_base (460)..(460): a, c, t, g, unknown or other
  misc_feature (460)..(460): n is a, c, g, or t
  modified_base (504)..(504): a, c, t, g, unknown or other
  misc_feature (504)..(504): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcactggggtcccnccaggcctccgaggcgaagggggctgggaggtgggtgctatttanatcagatgatgggacaagtaataaaggatatgcagtctcgtgaggcatcacatcncagagactaactcccaagaacacactgtatctagacaaatagaactagtattagagaagcnggagcgacggtcttggttgttatttcgtggtcgacgaaccgttntaagttggtaagggg

SEQ ID NO: 328763 - DNA, 517 bp, Homo sapiens
  misc_feature: GZ8MTXP01C1LPK.51.76.G10.1.454.CMB.2.raw
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggtcccncaggctccaggcaagggggctgggagtgggngcatttanatcagatgatggacaaagtaaanaagagtatgcagtcncggtgaagggccgatcacatctaccagagacaatacccaagaacaacactgtatctagacaaatgaacagtatgagagctaagaggacacggngttgtgttatttcngttgacgtaaacgngtagttaggtaaggttggggtaagggg

SEQ ID NO: 328764 - DNA, 567 bp, Homo sapiens
  misc_feature: GZ8MTXP01D3J6K.51.76.G10.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (505)..(505): a, c, t, g, unknown or other
  misc_feature (505)..(505): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctctttaagaggtgtccagtgtcaggtgcagctggtggagtcgtgggggagcgtggtccaggcccgggagtccctgagctctcctgtncagcctntggattcaccttcagtgcctatggcatgcacgtggggtccccncgaggcctaccgaggacggagggggtctgggaggtgggtagacttatttatacncgagatgacgtagggaactaagtaaaagtaaaggtagtatcgactaggttccgtacggtaggaacggacctataccactactccacaagaacaactaactacccaagaacactactatactacacgaacaaataagaatagtagtagagaagngagacggacgacgtgttgttgttattgtgtaacgacgaacgttacgtaagttaaggtaaggg

SEQ ID NO: 328765 - DNA, 640 bp, Homo sapiens
  misc_feature: GZ8MTXP01ELIBM.51.76.G10.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagactctctgtgcagcctntggattcaccttcagtgcctagtggcatgcacgtgggtcccncaggctccgaggcgaaggggctggagtgggtgctatttanatnagatgagtgactaaaagtaaataagatatgacgtagtcgtacggaggaacggtactaacttaccactactacctaaccgaagaacgtaaacctaaacctaccccgaaagtaaacctaactaacgggttagttaactacgtaacgaaactaaagtaaacgtaaacgtaaagtaagttaagtaaggaacggtacggtaacggaacggaaccggtacggttacgttagttagtttacgtttcgttacggtaacggtaacgtaaacgtaacgtaggttagggtaaggggttaaggggtaagggg

SEQ ID NO: 328766 - DNA, 546 bp, Homo sapiens
  misc_feature: GZ8MTXP01C23GN.51.76.G10.1.454.CMB.2.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaactgcagctccagctcnatctatgatgcatccacgaaggcccatgatactcccagcctaggttcagtggcaggtgggtctggggacaggtagttcactctacacatcagcagcctgcagtctagaagtatttgacttaatttagttactgtacagtactaagttaataattaacgtcggtacccttaccgtacgttcgttttaacgggaccgttacgggggaccaaggtcgtagggagttacgttacgaaacgtaacgttggtcgggtacttcggaaccgaaccgttaag

SEQ ID NO: 328767 - DNA, 554 bp, Homo sapiens
  misc_feature: GZ8MTXP01BT6SF.51.76.G10.1.454.CMB.2.raw
  modified_base (198)..(198): a, c, t, g, unknown or other
  misc_feature (198)..(198): n is a, c, g, or t
  modified_base (411)..(411): a, c, t, g, unknown or other
  misc_feature (411)..(411): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangccacctctcctgcagggccagtcagagtgttagcagcgacttagcctggtaccagcaagaaacctggccaggcctcccgaggcctcctcatctatgatgcatccaacgaagggcccatgatactccccagcctaggttcaggtcggcaggttgggtctggggactaggtacgttcacttcacaaccatcagcagcctgcagtctagaagttntttgacttaattttagtactgtacagtctaaagttataaataacgtcgtcccttaccgtactcgtttgggacccgttaaggggacccaaggtccgtagggagacttacgaaaacgtacgtgtacggcttcggccttaaccgtg

SEQ ID NO: 328768 - DNA, 556 bp, Homo sapiens
  misc_feature: GZ8MTXP01AQPW8.51.76.G10.1.454.CMB.2.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtccnccaggctccgaggcgaagggggctgggagtgggggtgctatttanatcagatgatggacaaagtaaataagngtactgacagtcgtcggtaggacgggtccgatcactatctaccagacacaacttacccaaanaacacacgtagtactcacgaactaaagtacgaactagtagtagagagngtaagacggacgacgttcgtgttgttagttcgttagtaagtacgtaacgtacgtagttaggtaagggttaagggtaaggg

SEQ ID NO: 328769 - DNA, 503 bp, Homo sapiens
  misc_feature: GZ8MTXP01DQRK0.51.76.G10.1.454.CMB.2.raw
  modified_base (197)..(197): a, c, t, g, unknown or other
  misc_feature (197)..(197): n is a, c, g, or t
  modified_base (476)..(476): a, c, t, g, unknown or other
  misc_feature (476)..(476): n is a, c, g, or t
  modified_base (503)..(503): a, c, t, g, unknown or other
  misc_feature (503)..(503): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagccctggtaccagcagaaacctggccaggctcccaggctcctcatctatgatgcatccacaaggcccactgatactcccagccaggttcagtgcagtgggtctgggacagagttcactctcaccatcagcagcctgcagtctgaagtatttgactaatttagttactgttacagtctagtataataactggtcctcgtactctttggccgttaggggaccttaagcgtaggagnttacaaacgactgtggcttgcaacgtn

SEQ ID NO: 328770 - DNA, 525 bp, Homo sapiens
  misc_feature: GZ8MTXP01EL2SD.51.76.G10.1.454.CMB.2.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccacctctcctgcagggccagtcagagtgttagcagcgacttagcctggtaccagcagaaacctggccaggctcccaggctcctcatctatgatgcatccanaaggcccactgatactcccagccaggttcagtggcaggtgggtctgggacagagttcactctcacatcagcagcctgctagtctgaagtatttgactaatttacgttactgtacagcaagttataaataactcggtcccttaccgtactacgttttgggaccgttaggggacccaggcgttagggacgattacgaaacgacgtggaggtcttcgcgaaccgtaa

SEQ ID NO: 328771 - DNA, 543 bp, Homo sapiens
  misc_feature: GZ8MTXP01DEAAP.51.76.G10.1.454.CMB.2.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctcactgcccgtcaaccctggagagccggcctccatctcctgcaggtctagtcagagcctcctgcatagtattggatacaactattggattggcacctgcagaagccagggcagtctccacaggtccctgatctatttgattctaacgtccgggcccgggtcngacaggttcngtgcagtgatcaggcacagtatttanactagaaaatcgagcagagtgaggctggaaggggtagttgggtttaggggtttatcgtaagttgacgtaagtgactaaagtcctacttaaacctaaacttccctacgttaagtaccgtttcgggacgggttacgggaacccgtaagggtaggaagactacgaacgtcgaacgttggg

SEQ ID NO: 328772 - DNA, 549 bp, Homo sapiens
  misc_feature: GZ8MTXP01ECJ9M.51.76.G10.1.454.CMB.2.raw
  modified_base (154)..(154): a, c, t, g, unknown or other
  misc_feature (154)..(154): n is a, c, g, or t
  modified_base (298)..(298): a, c, t, g, unknown or other
  misc_feature (298)..(298): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccaggcccgggagtccctgagctctcctgtgcagcctctggattcaccttcagtgcctatggcagtgcacgtcgggtcccnccaggcctaccgaggcgaagggggctgggaggtggggtgctatttactatcgagatgagtgggactaaggtaaataaagacgtatgacagtctcgtagaacgggccattcacatctacagacacactaccagaacacactgactctagacaaatagaaactagtatcgagaagtcgaggacgacgtacggtnttagttcgttacgtttcgtaggtaacgtaacggaacgttcgtaaggttaagggtaaggg

SEQ ID NO: 328773 - DNA, 498 bp, Homo sapiens
  misc_feature: GZ8MTXP01CXEDQ.51.76.G10.1.454.CMB.2.raw
  modified_base (195)..(195): a, c, t, g, unknown or other
  misc_feature (195)..(195): n is a, c, g, or t
  modified_base (349)..(349): a, c, t, g, unknown or other
  misc_feature (349)..(349): n is a, c, g, or t
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtctgtgtctccaggggaaangccacctctcctgcagggccagtcagagtgttagcagcgacttagcctggtaccagcagaaacctggccaggctccaggctcctcatctatgatgcatccacaagggcccactgatactcccagccaggttcagtggcaggtgggtctgggacngagttcactctcaccatcagcagcctgcagtctagaagtatttgactaatttagttactgtcagtntaagtataagtaactcggtctccgtactactttgggaccaggggacaggtcgtgagnttacaaagactgtaggnttgcaactn

SEQ ID NO: 328774 - DNA, 675 bp, Homo sapiens
  misc_feature: GZ8MTXP01B1Y5S.51.76.G10.1.454.CMB.2.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggnggagtcgtgggggagcgtggtccaggcccgggaggtccctgagactctcctgtgcagcctctggattccaccttcagtgcctatggcatgcacgtgggtcccncaggcctcgaggcgaagggggctgggagtggggtgctagtttanatcagatgatgggactaaaagttaaataaggagtaactgactagtccgtaccgggtaggaaacggggcccgtattccaaccactccctaacccgaggtaacgaaccaaacttaccccaaaggaaaccaacctaaccgttaggttaacttaccttaaggaacctaaaaagttaccggaaaactaaggtaaagtttagggaaacggtaaggaccgttaagggaacgggttaaccggaaccgggttccgttagggttagttaacgtttttccgaggttaacgggaaccggtaaaaccgtcgttaggttagggtaaggggttggggggttaaaggggg

SEQ ID NO: 328775 - DNA, 566 bp, Homo sapiens
  misc_feature: GZ8MTXP01D4S6N.51.76.G10.1.454.CMB.2.raw
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (518)..(518): a, c, t, g, unknown or other
  misc_feature (518)..(518): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcagctggtggagtcgtgggggagcggtggtccaggcccgggagtccctgagactctccgtgtgcagcctctggacttcaccttcagtcgccttatggactatcggctacgtcggggtcccgccagggcctccgagggccgaagggggtccttggggaggtggggtgctaatttatatcagatgagtacgggactaagtaaataaacggagtatgacagtcctcggtgaacggcgattcactagtctacagacaacacttaccaagaacactactntactcnacaaatacgaatagtagttgagaagtcgaggaacggcgacgggttnttagttgttacttcgtagtcgaacggtaacgttgtaagttggtaaggg

SEQ ID NO: 328776 - DNA, 520 bp, Homo sapiens
  misc_feature: GZ8MTXP01DUZQV.51.76.G10.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (319)..(319): a, c, t, g, unknown or other
  misc_feature (319)..(319): n is a, c, g, or t
  modified_base (395)..(395): a, c, t, g, unknown or other
  misc_feature (395)..(395): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctnatctatgatgcatccacaagggccactgattacncccagccaggttcagtggcaggtgggtctgggacagagttcactctcaccatcagcagcctgcagttcaggaattnttgacttaatttattacgtgtacagactagtataataactacgtcctaccgtactacgttcgtacgacggacgacgacgtagagacttacgaacgtaacgtaagtcgtcgttacgtcgaacgtaa

SEQ ID NO: 328777 - DNA, 496 bp, Homo sapiens
  misc_feature: GZ8MTXP01ADNYU.51.76.G10.1.454.CMB.2.raw
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagcgatcgtatacacgaccggtgctcgatttagtcactcatacaggggtgatcaggactcctcagttcaccttctcacaatgaggctccctgctcagctcctggggctgctaatgctctggtctctggatccagtgggatattgtgagtgacgtcagtctccactctccctgcccgtcaccccctggagacgccggcctccgactctcctgcgaggtctagtcagagcctcctgcatagtattggatacaactagttgattgcactgcagaagccagggcagtctcacagtctgatctattgagttctaacgtccccgggccccggtctggaccagttcagtgcagtgatcgaggctacagtatttanactagaaatcgagcgagagtgagcngaggtgtggttgggttatcgtattgctagtnactagctacaanaactcttgtacgttcgttcggcggaggacaagggtnagctacgacgcgtaagnggtcg

SEQ ID NO: 328778 - DNA, 508 bp, Homo sapiens
  misc_feature: GZ8MTXP01B9ODS.51.76.G10.1.454.CMB.2.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
  modified_base (427)..(428): a, c, t, g, unknown or other
  misc_feature (427)..(428): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgttgggttttcctcgttgctcttttaagaggtgtccagtgtcaggtgcagctggtggagtcgtgggggagcgtggtccagcccgggagtccctgagactctcctgtgcagcctntggattcaccttcagtgcctatggcatgcacgtgggtcccnccaggcctccgaggcaagggggctgggagtgggtgctatttanactcagatgatcgganaagtaaataaagagtatgcagtctcgtgaaggcatcacatcncaganacaactacacacacactntatannanaananaatanagtagagaagagagagacgacgtcgttgttgttagttgtgtaacgacgaacgacgtaagttggtaagg

SEQ ID NO: 328779 - DNA, 559 bp, Homo sapiens
  misc_feature: GZ8MTXP01E22RW.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagccctctgcatagtattggatacaactattggattggcacctgcagaagccagggcagtctccacaggtcctgattctatttgagttctaacgtccccggggcccccgggtctgacgtaggttcagtggcaggtggatcgagggcacgagtatttataactagaaaatcgaagcagtaggtgggaaggctaggagggtagttggggtttaggggtttatcgtaagttgctaagtgacaacgtactactaaacaactccgttatacgttaccgtttcgggacgggaacgggaccgttaagggtggaagaagtaccaggaccgtaacgttgtaaggg

SEQ ID NO: 328780 - DNA, 547 bp, Homo sapiens
  misc_feature: GZ8MTXP01BC75J.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcacgtgggtccgcaggctccgaggcaagggggctggagtggtgctatttatatcagatgatagggacaaggtaaataaaaggagtaatggcagttcctaccggtagaaacgggccgaattccaaccaatcctaccaagacgaacaacttacccagaaacacactgtatctgacaaatacgaaatagtatagagaagcgaggacgacgacggtcttggttgttagttcgtaggtaacgacggaacgttcgtaaggttgggtaaggg

SEQ ID NO: 328781 - DNA, 553 bp, Homo sapiens
  misc_feature: GZ8MTXP01DPRYJ.51.76.G10.1.454.CMB.2.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccaggcccgggagtccctgacgactctcctgtgcagcctctggacttcaccttcagtgcctatggcatgcacgtgggcccncgaggcctccgaggcgaagggggctgggagttgggcgatatttantcagtatgagtcgataaaagtaaagtaagagtatgactacgtcgtacggtaggacggtctactcactactacacgagacaacaactaccaanaacactagtactatacanacaatagaacgaagtagtagagagngaagacgacgtacgttagtgttgttacgttcgttagtaagtacgtaacgtagtagttaggtaagggttaagggtaaggg

SEQ ID NO: 328782 - DNA, 520 bp, Homo sapiens
  misc_feature: GZ8MTXP01A8NF3.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcagaacctggccaggctcccaggctcctcatctatgatgcatccacaagggcccatgatactcccagccaggttcagtggcaggtgggtctggggacaggagttcactctcacatcagcagcctgcagtctagaagtatttgacttaatttattacttgtcagtactagtataataactcggtcctaccgtactcgttttcggccgttaggggtacccaagtcgtaggagacttacgaaacgacgtgtggcttcgcaacgtaac

SEQ ID NO: 328783 - DNA, 542 bp, Homo sapiens
  misc_feature: GZ8MTXP01C7APL.51.76.G10.1.454.CMB.2.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcggtgggggaggcgtggtccaggcccgggagtccctgacgactctcctgtgcagcctctggattccaccttcagtcgcctatggcatgcacgtcgggtcccnccaggcctcgaggcgaaggggctgggagtgggtgctatttanatnagatgatggactaaagtaaataagntangacagtcgtcgtagaacggcatcacatcacaganaacactccaagaacacactgtanctagaactaaatcgaaanaagtagtagagagngtaagaaggacgacgttcgtgttgttagttcgttagtaagacgtaacgtagtagttaggtaagggttaagggtaaggg

SEQ ID NO: 328784 - DNA, 571 bp, Homo sapiens
  misc_feature: GZ8MTXP01A81Z7.51.76.G10.1.454.CMB.2.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (509)..(509): a, c, t, g, unknown or other
  misc_feature (509)..(509): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattccaccttcagtcgcctagtcggcatcgcacgtcgggtcccnccgaggcctccgaggacgaaggggctggagtgggtgctatttanatcagatgatggactaaaagtaaataacgngtatcgactagtcgtacgtagacgggcctatcacctatctaccgagaacgtacaacttacccaagaacactactgtaactctagaacaaagtgaaanagtnttaggaagagctaagggaacggagtaccggngttagtgttatttcngggtaacgacgtaaacgtntagttaggtaagggttaaggggtaaggg

SEQ ID NO: 328785 - DNA, 520 bp, Homo sapiens
  misc_feature: GZ8MTXP01CKYPP.51.76.G10.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtgggttttcctcgttgctctttaagaggtgtccagtgtcaggtgcagctggtggagtcgtgggggagcgtggtccaggcccgggaggtccctgagactctcctgtgcagcctntggattcaccttcagtgcctatggcatgcacgtgggtccnccaggctccgaggcgaagggggctggagtgggngcatttanatcagatgatggcaaagtaanaagntangcagtctcgagaggctatcacatcacaganacacttccagaacacactgtatcagacaaatgaaananagtagagagngaagacgacgacgttcgtgttgttagttcgttcgtaagtacgtaacgtacgtagttaggtaagggttaaggggtaaggg

SEQ ID NO: 328786 - DNA, 521 bp, Homo sapiens
  misc_feature: GZ8MTXP01BGBNX.51.76.G10.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgattagcctggtaccagcagaacctggccaggctcccaggctcctnatctatgatgcatccacaagggcccatgatatcccagccaggttcaggtggcaggtgggtctggggacaggtagttcacttctcaccatcagcacgcctgcagtctagaagtatttgacttaatttattactgtcagtcagtataataacgtcggtaccttcgtactcgtttcggccgttaggggacccaggtcgtagggagcttacgaaacgtacgtggtggcttcgcaaccgtaacg

SEQ ID NO: 328787 - DNA, 507 bp, Homo sapiens
  misc_feature: GZ8MTXP01AV87U.51.76.G10.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcactgggtccnccaggcctccgaggcaagggggctgggagtggggtgctatttantcagatgatggcaaagtaataagngtatgcagtctcgtgaaggcgatcacatctacagagacaattcccaagaacacatgtatctagacaaatagaaananatagagagngngagacgacgcgtgtgttagttgttgtgacgaacgactagttagtaaggttgggtaaggg

SEQ ID NO: 328788 - DNA, 546 bp, Homo sapiens
  misc_feature: GZ8MTXP01AIQKA.51.76.G10.1.454.CMB.2.raw
  modified_base (378)..(378): a, c, t, g, unknown or other
  misc_feature (378)..(378): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccaggggcagtctccacgaggtcctgatctatttgagttctaacgtccccggggccccgggtctgactggttacagtggcaggtggatcgaggcacagtatttanactagaaatcagcgagaggtggaggctaggaggaggttgggtttggggtttatcgtagttgctagtgactaagtctactaacctaaacctccttacgtacgttacgtttcgggacgggttacgggaccgaagggtggaagaagtacgacggacgtaacgttgtaacgg

SEQ ID NO: 328789 - DNA, 582 bp, Homo sapiens
  misc_feature: GZ8MTXP01C8RPQ.51.76.G10.1.454.CMB.2.raw
  modified_base (256)..(256): a, c, t, g, unknown or other
  misc_feature (256)..(256): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctntggattcaccttcagtgcctatggcatgcactgggtcccgccaggcctccgaggcgaagggggctgggaggtgggtggctagtttatactcagatgatgggactaagtaaataaaggagttatgctagttcctccggtagaacggggccgtaattccaaccctactcctacccaaggaacgaacctaaacttaccccaacgaaaccaacctacttagtactctagacaaagtagaactagtagttagagaagcgttaggacggacgtacgggcttggttgttagtttcgtagttggacggaaacgttcgttaagttgggtaagggg

SEQ ID NO: 328790 - DNA, 518 bp, Homo sapiens
  misc_feature: GZ8MTXP01DWWRM.51.76.G10.1.454.CMB.2.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccncaggctcgaggcaaggggctggagtgggtgctatttanatcagatgatggacaaagtaataagntatgcagtctcggtagaacgggcattcacatctacgaganacaacttcccaagaacacagtcgtatctgacaaatgaacaagtntagagagtnaagaggacacggttcgtgtgttagtttcagtgacgaacgtntagttaggtaaggttggggtaaggg

SEQ ID NO: 328791 - DNA, 590 bp, Homo sapiens
  misc_feature: GZ8MTXP01DA9LC.51.76.G10.1.454.CMB.2.raw
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctctgtgcagcctntgattcacttnagtncctangcatgcacgtcgggcccncaggcctccgaggcgaagggggctgggagtgggngactatttantcaagatgatggactaaaagtaaataagcgtatggactagtctacgggagaacgggtccaattccaactatcctacgaagtacgaacctaacttcccaaagtaaccactacgttagtacttccgaagaactaaaagtcgaaactaagtattagggaagacgcgtaaggaacggacgacgggttgttaggttagtttacgttcgaggtaacgaacgtaacgtcgtaggttgggtaaggggttaagggggtaacgg

SEQ ID NO: 328792 - DNA, 545 bp, Homo sapiens
  misc_feature: GZ8MTXP01EXK7I.51.76.G10.1.454.CMB.2.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctccaggctcctcatcatgatgcatccagaagggcccatgatacncccagccaggttcagtggcaggtgggtctggggacaggtagttcacttctacacatcagcagcctgactagtctgaagttntttgtacttaattttattacttgtacagtactaagttattaactaacgtcgtccttaccgttactcgttttcgggaccgttacggggaccttaaggcgtaggacgttattactaaacttacgtgtcggcttacgtcttaaccgtaac

SEQ ID NO: 328793 - DNA, 560 bp, Homo sapiens
  misc_feature: GZ8MTXP01BN44Y.51.76.G10.1.454.CMB.2.raw
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagccctcctgcatagtattggatacaactattggattggcacctgcagaagccagggcagtctcanaggtcctgatctatttgagttctagtccccggggccccgggtcngacaggttcagtggcagtgggatcaggcactagtatttatacgtagaaaatcaagtcaggaggtggaggcgtagggtaggtaggtttagggtttgggggtttatcgtagtttgactagtggactagtccttactaacaaacttcccgttgttaacggcgtttccggggacgggacgggttaccgaaggggtggagggtaactcgaacggttacgtaacgttgggtcgg

SEQ ID NO: 328794 - DNA, 529 bp, Homo sapiens
  misc_feature: GZ8MTXP01DBKFB.51.76.G10.1.454.CMB.2.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgagactctcctgtgcagccctctggattcaccttcagtgcctatggcatgcacgtgggtcccnccaggcctccgaggcaagggggctgggagtgggnggctatttantcagatgatggcaaagtaataagngtangcagtctcgngaggcgatcaccatctcagagacaacttcccagaaacacactagtatctagacaaagtgaaacaagattagagagcgtaagaggacgacggcgtagtgttagtttcgttgttgtacgtaacgactagttaggtaaggttaagggttaagggg

SEQ ID NO: 328795 - DNA, 510 bp, Homo sapiens
  misc_feature: GZ8MTXP01ENAHJ.51.76.G10.1.454.CMB.2.raw
  modified_base (197)..(197): a, c, t, g, unknown or other
  misc_feature (197)..(197): n is a, c, g, or t
  modified_base (361)..(361): a, c, t, g, unknown or other
  misc_feature (361)..(361): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtagcagcgattagcctgaccagcagaactgccaggctccagctctcatctatgatgcatccagaagggcccaactgatactcccagccacggttcagtggcaggtgggtctggggacagcgttcactctcaccntcagcagcctgcagtctgaagtctttgacttaattttattactgtaccagctaagtataactaactcggtccttaccgtactcgtttggccgttaggggaccaaggcgtaggagttattacgaacgactgtggacttcgccaacgtaac

SEQ ID NO: 328796 - DNA, 524 bp, Homo sapiens
  misc_feature: GZ8MTXP01DM5VU.51.76.G10.1.454.CMB.2.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtntctccaggggaaangccacctntcctgcagggccagtcagagtgttagcagcgacttagccctaggtaccagcagaaacctggccaggctcccagcctctnatctangatgcatccanaggccactgatacnccagccaggttcagtggctaggtcgggtctggggacagacgttcactctacaccatcagcagcctgcagtctagaagtatttgactattttattactgtacagactagtataataaactggtccctacgttactcgtttcggaccgagggggtaccaaggctagggaagacttacgaaaaccgtagtggttaggcttgccgaaccgtaag

SEQ ID NO: 328797 - DNA, 580 bp, Homo sapiens
  misc_feature: GZ8MTXP01AUW75.51.76.G10.1.454.CMB.2.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgacttagcctggtaccagcagaacctggccaggcctcccgaggcctcctcatctatgatgcatccacgaacggccactgactactcccagcctaggttccaggtcggactaggtcgggtctggggactaggtacgttccacgtctcaccatcagcacgcctgctagtctagtaagtatttagacttaatttagttactgtacagtactagtaataattaacgtcgtccttaccgtaccttcgtttcggaccggttaggggtacttacgtaacggtcgttagggttacgttaacgtaaccgtaaaacggtaacgtgggtacggttaccgtcgaacccgtaaccg

SEQ ID NO: 328798 - DNA, 559 bp, Homo sapiens
  misc_feature: GZ8MTXP01D7WQ0.51.76.G10.1.454.CMB.2.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (513)..(513): a, c, t, g, unknown or other
  misc_feature (513)..(513): n is a, c, g, or t
  modified_base (544)..(544): a, c, t, g, unknown or other
  misc_feature (544)..(544): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgagctctcctgtgcagcctctggattcaccttnagtgcctagtggcatgcacgtcgggtcccnccaggcctccgaggcgaagggggctgggaggtgggtgactagtttanactcagtatgactgggacaaggtaaataaagagtaactgactagtccgtaccggtaggaacgggccgtattaccaccctaattcctaccgagacgaaccaacttacccaagaaccacactgtatctagacaaatacgaatagtatgagaagcttggacgacgacggtnttgttgttatttcgtggtaacgacgtaacgntaagttggtaagggg

SEQ ID NO: 328799 - DNA, 578 bp, Homo sapiens
  misc_feature: GZ8MTXP01A2F7G.51.76.G10.1.454.CMB.2.raw
  modified_base (196)..(196): a, c, t, g, unknown or other
  misc_feature (196)..(196): n is a, c, g, or t
  modified_base (395)..(395): a, c, t, g, unknown or other
  misc_feature (395)..(395): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaacctggccaggctccaggctcctcatctatgatgcatccacgaacgggccactgatactcccagccaggttcagtggcaggtgggtctggggacagtagttcactctcaccatcagcagcctgcagtctagaagtntttgacttaatttagttactgttacagtactaagtaattaaactaaacgtcggtcccttaccggttactacgttttcgggacccgttacgggggtaacccaaaggtccgtaggggaacgttacgttaaccgaaaaccggtaacgttgggtacgggtccgttacgggtcccgaacccgttaacg

SEQ ID NO: 328800 - DNA, 504 bp, Homo sapiens
  misc_feature: GZ8MTXP01EX3NC.51.76.G10.1.454.CMB.2.raw
  modified_base (196)..(196): a, c, t, g, unknown or other
  misc_feature (196)..(196): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggcccactgatatcccagccaggttcagtggcaggtgggtctgggacagagttcactctcaccatcagcagcctgcagtctgaagtatttgactaatttagttacttgtacagcagtaataataaactggtcctccgtactcgttttggccgagggggtaccaagcgtggagnttacaagactgtggcttgcaaccgtaa

SEQ ID NO: 328801 - DNA, 601 bp, Homo sapiens
  misc_feature: GZ8MTXP01A8DOX.51.76.G10.1.454.CMB.2.raw
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (483)..(483): a, c, t, g, unknown or other
  misc_feature (483)..(483): n is a, c, g, or t
tcagcgatcgtatacacgaccggtgctcgatttagtcactcatacagggggggaggaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgagactctcctgtgcagcctctgacttcaccttcagtcgcctatggcatgcacgtgggtcccnccgaggcctccgagggcgaagggggctgggaggtggggtgactatttanatcgagatgatggactaaaagtaaagtaagagtatcgacgtacggtccgtacggtaggaacggtctattccactatcctacgagtacactaacttacccaagaactacatagtactcgtagaactaaagcgaanaggtattggaagtgcgtaaggaacggacgtacgggttcgttaggttagtttacgttcggacggtaacgtaaccggtaacgtcgttagggttagggttaaggggttaagggggtaaggg

SEQ ID NO: 328802 - DNA, 555 bp, Homo sapiens
  misc_feature: GZ8MTXP01C9RX9.51.76.G10.1.454.CMB.2.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctcgtggattcaccttcagtcgcctatggcatgcacgtgggtcccnccaggcctccgaggccgaagggggctggaggttgggtgctatttanatcagatgatgggacaagtaaataaagagtatgcagtcctacgtagaacggccattcacatcctacagacactaactacccaagaacactactgtaatctagacaaagtacgaaactagtataggaagaagcgttaggacggacgtacgggtcttaggttgttactttcgagtaacggaccgaaagttcttaaggttaaggtaagggg

SEQ ID NO: 328803 - DNA, 568 bp, Homo sapiens
  misc_feature: GZ8MTXP01ALQSK.51.76.G10.1.454.CMB.2.raw
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (546)..(546): a, c, t, g, unknown or other
  misc_feature (546)..(546): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcccgggaggtccctgagactctcctgtgcagcctctggattcaccttcagtgcctatggcatgcacgtcgggtcccnccagggcctccgaggcgaagggggctgggagtggggtgctatttanatcagatgatggataaagtaaataagntangacagtcncgtagacgggccattccactatctaccaagacgaccaacttcccaaagaaccacacgtgttaactctagacaaagtagaaacaagtagttgaagagcgtaaggaacgacgtacgggttcgttggttagttacgttgttaggtaacggtacgtaacgtcgttaggngggtaaggggttggggtaaggg

SEQ ID NO: 328804 - DNA, 621 bp, Homo sapiens
  misc_feature: GZ8MTXP01CUYJ9.51.76.G10.1.454.CMB.2.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctctggattcaccttnagtgcctatggcatgccacgtcgggtcccnccgaggcctccgaggcgaaggggctgggaggtggggtgacttatttanatcgagtatgagtggactaaaaggtaaataaggagtagtagcgtaagtccgttacggaggaacgggtcctaattccaacctattacccgaccaaggtaactaacctaaacgttaccccaaagtaaaaccaccgtaacttaggtaacttccgtaagaaacctaaaagtcggaaaactaggattaggagaagcgtaagggaacgacgtacggttcgttaggtcgttaatttcgaggtaagaacgaacgtgtagttggtaagggttgggttaaggggg

SEQ ID NO: 328805 - DNA, 652 bp, Homo sapiens
  misc_feature: GZ8MTXP01AKE95.51.76.G10.1.454.CMB.2.raw
  modified_base (150)..(150): a, c, t, g, unknown or other
  misc_feature (150)..(150): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttccncgttgctctttaagaggtgtccagtgtcaggtgcagctggtggagtcgtgggggagcgtggtccaggcccgggaggtccctgagactctcctgtgcagcctctggattcaccttcagtgcctatggcatgcacgtgggtcccaccnggcctccgagggcgaagggggctgggaggtggggtgctatttanatnagtagtagtagtagtagtaaaagtaaagtaagtaagtagtagtacgtacgtcgtacggtacgggtaacgggtaccgtactacctacctactacctaccgaacgaacgtaaacctaaccttaacccgtaacgaaaccaacctaacgtacgttactactacgtaacgtaaagtaacgtaaacgtaagtaagtagtaagacgacgtaacggaacggacggtacggttcgttaggttaggtttacgtttcgttacggtaacggtaacggtaaccggtacgtaggttagggtaaggggttaaggggttaagggg

SEQ ID NO: 328806 - DNA, 519 bp, Homo sapiens
  misc_feature: GZ8MTXP01D4AO1.51.76.G10.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctntggacttcaccttcagtgcctatggcatgcacgtgggtcccnccaggcctccgaggcgaagggggctggagtggtgctatttanatcagatgatcggactaaagtaanaagntanganagtcncgtagaacggctatcacatcacagtanacaatcccaagaacacactgtatcagaacaaatgaaacagtatagagagcngacgacgacggctagtgttatttcgngtgaccgaagtctagttggtaaggttaagggtaaggg

SEQ ID NO: 328807 - DNA, 562 bp, Homo sapiens
  misc_feature: GZ8MTXP01EP7DJ.51.76.G10.1.454.CMB.2.raw
  modified_base (342)..(342): a, c, t, g, unknown or other
  misc_feature (342)..(342): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctctgattccacttcagtgcctatggcatgcacgtgggtcccgccaggcctccgagggccgaagggggctgggaggtgggtgctatttanatcagatgatggacaaagtaaataagagtatgctagtctcgtagaggcatcacntctacaganacacttacccaagaacacacgtgtactctagacaaatcgaaacagtattagagacgtctaaggaacggaccgaagggttcttaggttgttaacgttttcagggttaacgacggtaaaacgtcgtagttagggtaaggggtttgggggttaaaggggg

SEQ ID NO: 328808 - DNA, 555 bp, Homo sapiens
  misc_feature: GZ8MTXP01AR99G.51.76.G10.1.454.CMB.2.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagagtgtagcagcgattagcctggaccagcagaactgcagctccagctcnatctatgatgcatccacgaaggccatgatactccagccaggttcagtggcaggtgggtctgggacagtgtcactctacacatcagcagcctgcagtctagtaagtatttgacttaatttagtactgtacagtactaagtaattaacttaaacgtcgtaccttaccgttaacttccgtttaagggacccgttaaagggggtaacccaaggtaccgttagggaacggttaacttaccgaaaaccggtaagttcgggtcggacttacggaaccttaaccgttaacg

SEQ ID NO: 328809 - DNA, 555 bp, Homo sapiens
  misc_feature: GZ8MTXP01AU07I.51.76.G10.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (452)..(452): a, c, t, g, unknown or other
  misc_feature (452)..(452): n is a, c, g, or t
  modified_base (490)..(490): a, c, t, g, unknown or other
  misc_feature (490)..(490): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagctggtggagtcgtgggggagcgtggtccaggcccgggagtccctgacgctctcctgtcgcagcctcgtgacttccaccttnagtgcctatggcatgcacgtcgggtccncaggctccgaggcgaaggggctggagtgggtgactatttantcgagtatgatggactaaagtaaataagngtangcagtcncgtaggacggtctatcacntcacagacactaactcccaagaactacacgtgtaactctaacgaataaagngaacaggtataggagagcgtaaggaaggactacggttnttggttacttagttttcgaggttaagacgtaaacgnttaaggngggtaaggttgggggtaaaggg

SEQ ID NO: 328810 - DNA, 570 bp, Homo sapiens
  misc_feature: GZ8MTXP01ER3TO.51.76.G10.1.454.CMB.2.raw
  modified_base (423)..(423): a, c, t, g, unknown or other
  misc_feature (423)..(423): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (526)..(526): a, c, t, g, unknown or other
  misc_feature (526)..(526): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcccgggaggtccctgagactctcctgtgcagcctctggattcaccttcagtgccctatggcatgcactgggtccgccaggctccgaggcgaagggggctgggaggtggggtgctatttatatcagatgagtcggactaagtaaaataaagacgtatgacagtcgtcgtaggaacgggccgattccactactctccaaganaccaattaccccagtaaacacactgtaatctagacaaatanaacgtagattnaaggaagtcaggaaacggcgacgggtacttgggttacttacgttttaacgnggttaacgaaccgggaaaacgttacgttaagggttgggtaaggg

SEQ ID NO: 328811 - DNA, 528 bp, Homo sapiens
  misc_feature: GZ8MTXP01BID32.51.76.G10.1.454.CMB.2.raw
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (340)..(341): a, c, t, g, unknown or other
  misc_feature (340)..(341): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagctctcctgtgcagcctctggattccacttcagtcgcctatggcatgccacgtgggcccncgaggcctccgaggcgaagggggctgggagtgggtgctatttanannagntgatgganaaagtaaanaagagtangacgagtcgacgagacgctatcacntcacagacacaactaccaanaacacagtagtactctagaacaaanagaagagtagtagagagngaagaggacgacgttgtgttgttgttgttgtaagacgaacgtagtagttaggtaagggttaagggtaaggg

SEQ ID NO: 328812 - DNA, 548 bp, Homo sapiens
  misc_feature: GZ8MTXP01D8QDG.51.76.G10.1.454.CMB.2.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtgggtttcctcgttgctcttttaagaggtgtccagtgtcaggtgcagctggtggagtcgtggggggagcgtggtccaggcccgggaggtccctgagactctcctgtgcagcctctgattcacttcagtgcctatggcatgcacgtgggtcccncaggcctccgnggcgaagggggctgggagtgggtggctatttanatgagatgagtgataaagtaaanaagntangactagtcgtacgtaggacgctactcactatcacagacactactaccaanaacactacgtatatactaganaatagaagaagtagtagagagngtaaggacggacgacggttcgtgttgttagttcgttacgtaacgtacgtaacgtacgtaggttaggtaagggttaaggggtaaggg

SEQ ID NO: 328813 - DNA, 519 bp, Homo sapiens
  misc_feature: GZ8MTXP01BHCIY.51.76.G10.1.454.CMB.2.raw
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggtcccncaggcctccgaggcaagggggctgggagtgggtgctatttanatcagatgatggacaagtaataaagngtatgcagtctcgtgaggcgatcacatctcaganacaatcccaagacactactgtaactctagactaaatacgaacaagtattgaagaagcgttgaggacgacgggtcttggttgttactttctggtcgacggaacgttcgtaagttggtaaggg

SEQ ID NO: 328814 - DNA, 546 bp, Homo sapiens
  misc_feature: GZ8MTXP01D4N0S.51.76.G10.1.454.CMB.2.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (408)..(408): a, c, t, g, unknown or other
  misc_feature (408)..(408): n is a, c, g, or t
  modified_base (512)..(512): a, c, t, g, unknown or other
  misc_feature (512)..(512): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctctgtgcagcctntggattcaccttnagtgcctatggcatgcacgtgggtcccnccaggcctccgaggcgaagggggctgggagtgggtgctatttanactcagatgaatggacaagtaaataaagntatgactagtcctcgtagagggccattcacatctacaganactaatcccaagtaacacacttgtactctagacaaagtagaaactagtaagttgaaggaagtcttagggaacgacccgtaaggtccttggttgttattttccgngtcggtaacgaaacgttnttaagngggtaagggg

SEQ ID NO: 328815 - DNA, 555 bp, Homo sapiens
  misc_feature: GZ8MTXP01ATAFE.51.76.G10.1.454.CMB.2.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgagctctctgtgcagcctctggattcaccttcagtgcctatggcatgcacgtgggtccnccaggcctccgaggcgaagggggctggaggtgggtgctagtttanatcagatgatgggacaagtaaanaaagngtatgctagtctccgtggaacgggcgaattccactatctacagacactaacttacccaagaacactactgtactacctgacaaagtcgaaactagtagtagagaagcgttaggacggacgtacggtcttggttcgtttagtttcgtaggtaacggaacgtaacggttacgtaaggttaagggtaaggg

SEQ ID NO: 328816 - DNA, 579 bp, Homo sapiens
  misc_feature: GZ8MTXP01EIULJ.51.76.G10.1.454.CMB.2.raw
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagctctcctgtgcagcctctggattcaccttcagtgcctatggcatgcactgggtcccnccaggctccgaggcaagggggctggagtggggtgctatttanatcagatgagtggacaaaagttaaataagagtatgactacgtcgtcggtaggaacgggcctacttccactatcctaccgagacaactaactacccaagaaccactacgttagtactcgtagaacaaagtacgaaacaagtagtagaagagcgtaaggaacggaccgtacggttcgttagttagtttagtttcgttaggtaacgtacgtaaacgtcgtagttagggtaagggttaaggggtaaggg

SEQ ID NO: 328817 - DNA, 564 bp, Homo sapiens
  misc_feature: GZ8MTXP01DH3UP.51.76.G10.1.454.CMB.2.raw
  modified_base (252)..(252): a, c, t, g, unknown or other
  misc_feature (252)..(252): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctcatctcctgcaggtctagtcagacgcctcctgcatagtattggatacaactnttggattggcacctgcagaagccgagggcagtcctccacgaggtcctgaattcttatttgacgttcgtaacggtcccccggggcccccgggtctggactaggttcagtcggctaggtggactcgaggcaacagttactttanactagaaaatcagtcagagtggagngtaggaggtagttcgggtttaggggtttatacggtattcgatagttagactaagtcttacaaactaaaccgttccttcgtacgttacggttccgggaggaacgggttacaagggttgaagtaagtacgaacgcgtaacgttggcg

SEQ ID NO: 328818 - DNA, 546 bp, Homo sapiens
  misc_feature: GZ8MTXP01CDG59.51.76.G10.1.454.CMB.2.raw
  modified_base (151)..(151): a, c, t, g, unknown or other
  misc_feature (151)..(151): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtggtttccncgttgctctttaagaggtgtccagtgtcaggtgcagctggtggagtcgtgggggagcgtggtccaggcccgggagtccctgacgactctctgtgcagcctctggattccacttcagtcgcctanggcatgcacgtgggtcccncaggctccgaggacgaggggctggagtgggtgctattanatcagatgatggacaaagtaaataagntatgacagtctcgtagaacgggcctatcacatctacaganacactacccaagacacgtatcgttatctacgactaaatcgaaactagtgtagagagcaaggaacgttaccggcggttgttagttgttacgttcgttacgtaacgtacgtaacgtcgtaggttagggtaagggttaagggtaagggg

SEQ ID NO: 328819 - DNA, 593 bp, Homo sapiens
  misc_feature: GZ8MTXP01A4CQA.51.76.G10.1.454.CMB.2.raw
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcctcgttaggctctttaagaggtgtccagtgtcaggtgcagctggtggagtcgtgggggagcgtggtccagcccgggagtccctgagactctcctgtgcagcctctggattcaccttcagtgcctatggcatgcacgtgggtcccgccaggcctccagggcgaaggggctgggaggtgggtggctatttanatgagntagagtgataaagtaaanaagtgtactgactagtcgtacgggtaggaacgggtcctactaccactactaccacgaagaacgtaactaaactacccgaaagaaccacgtacgttacgtactacgtacgaacgaaagtaacgaacgaagtagtagagagngaacggacggacgacggttacgtgttagttacgttcgttacggtaacggtacgtaacgtacgtaggttaggtaagggttaaggggtaaggg

SEQ ID NO: 328820 - DNA, 593 bp, Homo sapiens
  misc_feature: GZ8MTXP01C4Y5U.51.76.G10.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (538)..(538): a, c, t, g, unknown or other
  misc_feature (538)..(538): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctctggattcaccttcagtgcctatggcatgcacgtgggtcccncaggcctcgaggcaagggggctgggagtgggngctagtttanatcagatgatggactaaaagtaaataaggagtaatgactagtcgtacggtaggaacggggtcctattaccaacctatcctaccgagtaactaacctaacgttaccccaaaacgaaacctacctacgttacgtactactacgaactaaagtagaacgtagtataggagacgcgaaggaacggacgtacggttgttaggttnttagttcgttaggtaagacgtaacgtgtaggttagggtaagggttggggtaaggg

SEQ ID NO: 328821 - DNA, 543 bp, Homo sapiens
  misc_feature: GZ8MTXP01A9RIW.51.76.G10.1.454.CMB.2.raw
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
  modified_base (517)..(517): a, c, t, g, unknown or other
  misc_feature (517)..(517): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgaaactctcctgtgcagcctctggattcaccttnagtgccctatggcatgcacgtgggtcccnccaggcctccgaggcgaagggggctgggaggtgggtggctatttanatcagatgatggacaagtaaaataaagngtatgcagtctcggngaagggcattcacatctacagagacaacgttaccccagaacacactaggtactctagacaaatcgaaanagatgagagcgtaggaagacgacgggtcttgtagttatttcgttgttcgaacgtaacgcttagnggaggtggggttaagggtttaagggg

SEQ ID NO: 328822 - DNA, 510 bp, Homo sapiens
  misc_feature: GZ8MTXP01B2NQX.51.76.G10.1.454.CMB.2.raw
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgagactctcctgtgcagcctctggattcaccttcagtgccctatggcatgcacgtgggtccnccaggctccgaggcaagggggctggagtgggtgcagtttanatcagatgatggacaagtaaataaagagtactgcagtctcgtgaaggcgattcacatctacagagacaatcccagaacactactgtaatctagacaaatagaatanatgagaagcgttgaggacgacggcgttgttgttagttntgtgtacgaacgacgtaagttgtaaggg

SEQ ID NO: 328823 - DNA, 538 bp, Homo sapiens
  misc_feature: GZ8MTXP01CLTRB.51.76.G10.1.454.CMB.2.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtncagcctctgattcacttnagtgcctangcatgcacgtgggtcccgccaggcctccgagggcgaagggggctgggagtgggtgactatttanatcagntgatggacaaagtaanaagntanganagtcncgtagagcatcacatcacagacgactaactacccaagaaccactacgtagtactctagacaaagtgaacgagagttagagtgcgtaaggaacggacacggttgttagtntttacgttcgttagtaagacgtaacgtntaggttaggtaaggttaagggtaagg

SEQ ID NO: 328824 - DNA, 520 bp, Homo sapiens
  misc_feature: GZ8MTXP01D8BMZ.51.76.G10.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagcccgggagtccctgagactctcctgtgcagcctctggattcaccttcagtgcctatggcatgcacgtgggtcccncaggctccgaggcgaagggggctgggagtgggtgctatttanatcagntgatggacaaagtaanaagntatgctagtctcgtgacggctatcactntctacagagacaactacccagtaacacacgtcgtatctagacaaatcgaanagtatgagagctaagagacgacggntgtgttatttcgttggtgacgaacgtntagttaggtaagggttggggtaaggg

SEQ ID NO: 328825 - DNA, 561 bp, Homo sapiens
  misc_feature: GZ8MTXP01CE9KO.51.76.G10.1.454.CMB.2.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctntggattcaccttcagtgcctatggcatgccacgtcgggtcccnccaggcctccgaggccgaagggggctgggaggtgggtgctatttantcagatgagtgacaaagtaataagntangcagtctcggagaacggctatcactatctaccagacacaacttcccaagaacacatgtactctacgaacaatgaaacagtattagagaacgtcgaaggtacggacgtaccgggcgttaggttgttagtttccgaggttaacgaccggtaaacgtgttaggttaggtaaggggttaagggggttaagggg

SEQ ID NO: 328826 - DNA, 540 bp, Homo sapiens
  misc_feature: GZ8MTXP01CS36Y.51.76.G10.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggcctcccaggcctccncatctatgatgcatccacgagggcccaatgactactcccagccgtaggttcaggtggcaggtgggtctggggacaggtacgttcacgtctacacatcagcagctgcagttcagtatntttgacttaatttatactgtacagtactagtaactaattaacgtcgtcccttaccgtacttcgtttcggaccggttaggggtaccaggtcgtaggacgttacttaccgaaagtacgtggtggccttagccgaacgtaac

SEQ ID NO: 328827 - DNA, 542 bp, Homo sapiens
  misc_feature: GZ8MTXP01AE1X5.51.76.G10.1.454.CMB.2.raw
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattccaccttcagtcgcctatggcatcgcacgtgggtcccnccgaggcctccgaggcgaagggggctgggagtggggtgactatttanatcagatgatggacaaagtaataagntatgctagtcncggtagacggcatcacntcacagacactactcccaagacacactgtactctagacaaatcgaactagtagtagaagtgcgtaaggaacggacacggttnttggttagttagttcgttagtaacgacgaacgtntagttgggtaaggttgggtaagggg

SEQ ID NO: 328828 - DNA, 534 bp, Homo sapiens
  misc_feature: GZ8MTXP01C4U2I.51.76.G10.1.454.CMB.2.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccatggagaagtagtgatgacgcagtctccagccaccctgtctgtgtctccgaggggaaangcccaccctctcctgcagggccagtcagagtgtagcagcgacttagcctggtaccagcagaactggcaggctccaggctctnatctatgatgcatcccaacgaagggcccaagtgaactactcccagccctaaggttccgagtggctagggtcgggtcgtggggacaggacgtttcacttcacaccatcgancgagccctgacagtctagaagttatttnacttaaatttagttactgtacagataagtaataataacgtcggtaccttcgtacttagtttcgacgaggggaccaaggcgtagacgttnttacgaaagtactgtggcttagccaatcg

SEQ ID NO: 328829 - DNA, 587 bp, Homo sapiens
  misc_feature: GZ8MTXP01C3450.51.76.G10.1.454.CMB.2.raw
  modified_base (199)..(199): a, c, t, g, unknown or other
  misc_feature (199)..(199): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaangccaccctctcctgcagggccagtcagagtgtagcagcgattagcctggtaccagcagaacctggccaggctccaggctcctnatctatgatgcatccacgaagggcccaagtgatactccccagccgtacggttcaggttcggcgaggttcggggtctgggggacctagggtacgtttcactctacaccatcagcacgcctgctagtctagtaagtatttgacttaatttattactgtcagtactaagtataatacgtcggtaccctccgttactccgttttcgggacccgttaacgggggtaccaaggtaccgtaagggaacgttacgttaacccgaaaacggtaaccgttgggtacgggtccttacggaacccgaaccgttaacg

SEQ ID NO: 328830 - DNA, 576 bp, Homo sapiens
  misc_feature: GZ8MTXP01C0GX9.51.76.G10.1.454.CMB.2.raw
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (435)..(435): a, c, t, g, unknown or other
  misc_feature (435)..(435): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctcatctcctgcaggtctagtcagacgcctcctgcatagtattggatacaatnttggattggcactgcagagccagggcagtctccanaggtcctagatctatttgagttctaacgtcccccggggcccccgggtctgacaggttcaggtggcaggtggatcgaggtcactagtatttaanactagaaaatcaagcagaggtggaggntaggaggtaggttgggtttaggggtttancgtaagttggactagttacgacgtaaacgtcctacgtaaacctaaaccttcccgttacgttaacgttaccgtttccggggacggttaacgggaccgttaaggggtaagaagaacgtacgaaggacgtaacgttggtaacgg

SEQ ID NO: 328831 - DNA, 510 bp, Homo sapiens
  misc_feature: GZ8MTXP01E1HHO.51.76.G10.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagcccgggagtccctgagactctcctgtgcagcctctggattcaccttcagtgcctatggcatgcacgtgggtcccnccaggctccgaggcaagggggctgggagtgggtgctatttanatcagatgatgggcaagtaaataaagngtatgcagtctcgtgaagggccatcacatctcaganacaatcccagaacacactgtanctgacaaatgaaactaanatagagaagagttgaggacgaacggcgttgttggttatttctgttgacggaacgacgtaagttgtaaggg

SEQ ID NO: 328832 - DNA, 554 bp, Homo sapiens
  misc_feature: GZ8MTXP01B9PXU.51.76.G10.1.454.CMB.2.raw
  modified_base (198)..(198): a, c, t, g, unknown or other
  misc_feature (198)..(198): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcagggccagtcagagtgtagcagcgtacttagcctggtaccagcagaacctggccaggctcccgagctctcatctatgatgcatccagacggccatgactactcccagcctaggttcaggtggctaggtgggtctggggactagtagttcactctcaccatcagcacgctgactagtctagtaagttntttgacttaatttacgttactgtcagctaagtataagtaaccgtcggtcccttacgtaccttcgtttcgggaccgttaacgggggacccttaaggtcgtagggaacgttacttaaccgaaacgtacgtgtcgggcttacgaaccaaccgttg

SEQ ID NO: 328833 - DNA, 596 bp, Homo sapiens
  misc_feature: GZ8MTXP01DRS5Y.51.76.G10.1.454.CMB.2.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagcccgggaggtccctgagactctcctgtgcagcctgtggattcaccttcagtgcctatggcatgcacgtgggtcccncaggcctaccgaggcgagggggctgggagtgggtgctagtttanactcaagtatgatcggganaagttaaaataaaggagttaagngacgtacgtccgtacggtaggaacgggtcctacttaccaacctactcctacgaagacgaacctaactaacccaacgaaaccaactactacgtactacgtacgaactaaagtacgaaacgtaagtaagtaggaagaacggtcgagggacggacgacggtgttagttgtttacgtttcgtaggtaacgaacgtaacgttgtaaggttgggtaaggg

SEQ ID NO: 328834 - DNA, 584 bp, Homo sapiens
  misc_feature: GZ8MTXP01B6UV4.51.76.G10.1.454.CMB.2.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (472)..(472): a, c, t, g, unknown or other
  misc_feature (472)..(472): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtcccncaggcctccgaggcgaagggggctgggagtgggtgactatttanatcagatgatggactaaaagtaaataagagtatgactagtcctcgtagaacgggtccattacaacctatcctaccgagtacgaacctaacgttccccaagaacacacgtagtatcctagactaaagtcgaanagtatagaagtacgcgtaaggaacggacgtcggacgttggttaggtttactttcgttaggtaacggtaccggaaaacgtcgttaagttgggtaagggttggggttaaggggg

SEQ ID NO: 328835 - DNA, 572 bp, Homo sapiens
  misc_feature: GZ8MTXP01DIDT8.51.76.G10.1.454.CMB.2.raw
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (546)..(546): a, c, t, g, unknown or other
  misc_feature (546)..(546): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccaggcccgggagtccctgagactctctgtgcagcctctggattcacttcagtgcctatggcatgccacgtgggccncaggctccgaggcgaagggggctgggagtgggngtactatttanatcagatgagtggacaaagttaaataagngtatgactagtcgtccggtaggaacgggcctattaccactactcctaccagacacaaacttacccaagaaaccactacgttagtactctagactaaagtgaaacagtattaggaagtacgcgtaaggacggttaccgacggttcttaggtgtttacttcttggtaacgaacgaaacgtntaggttggaagggttggggttaaggg

SEQ ID NO: 328836 - DNA, 548 bp, Homo sapiens
  misc_feature: GZ8MTXP01AY927.51.76.G10.1.454.CMB.2.raw
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcactgggtcccnccaggctccaggcaagggggctgggagtggggtgctatttanatcagatgatggacaaagtaaataagagtatgcagtctcgtgacggccgattcaccatctccagagacaacttcccaagaaccacacgtgtatctagacaaatcgaacagtattagagagcgtggaacggacgacgggaccgttggttcgttaacttttcgttggttaacggacgtaaaccgtcgtagttacggtaagggttgggggtaagggg

SEQ ID NO: 328837 - DNA, 555 bp, Homo sapiens
  misc_feature: GZ8MTXP01DUO9E.51.76.G10.1.454.CMB.2.raw
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (487)..(487): a, c, t, g, unknown or other
  misc_feature (487)..(487): n is a, c, g, or t
  modified_base (539)..(539): a, c, t, g, unknown or other
  misc_feature (539)..(539): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggcccgggagtccctgagctctcctgtgcagcctcgtggattccacttcagtgcctagtggcagtgctacgtcggggtccccnccaggccctaccgaagggcgaagggggcttgggaggtggggtgactagtttanatcgagtatgatcgggataagtaaataaagngtangcagtcncgtagaacggcattcactatcctacagacactaactaccaagaacactactagtaactcagacaaatagaactagtatgacgaagnttaggacgacgtaggtcttaggttattactttggtgtaacggacgtaacggnttaagttgggtaaggg

SEQ ID NO: 328838 - DNA, 558 bp, Homo sapiens
  misc_feature: GZ8MTXP01DI018.51.76.G10.1.454.CMB.2.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattcaccttcagtcgcctatggcatgccacgtcgggtcccnccagggcctccgaggcgaagggggctgggagtgggtgctatttanatcagatgactggacaaagtaaataagntactgctagtctcggagacgggctatcactntcacaganacactaccanaacncacgtntactctacgacaaatgaaanagtagtagacgagcgtaaggacggacgtacggttgttagttagtttacgtttcgttaggtaacgaacgtaacgtagtagttagggtaagggttaaggggttaaggg

SEQ ID NO: 328839 - DNA, 554 bp, Homo sapiens
  misc_feature: GZ8MTXP01BZOKR.51.76.G10.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
  modified_base (499)..(499): a, c, t, g, unknown or other
  misc_feature (499)..(499): n is a, c, g, or t
  modified_base (536)..(536): a, c, t, g, unknown or other
  misc_feature (536)..(536): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattcaccttcagtcgcctatggcatgccacgtcggggtccccnccaggcctccgaggcgaagggggctgggaggtgggtgctatttanatcagatgatggacaagtaaataaagngtatgcagtctcgtagaacggcatcacatcacagacacaactaccaagaacactacgtntactcgtagaacaaatacgaaactagtattaggaagtaagcgttaggaacgttaccgacgggtnttaggttgttatttcgtagtaacggacgtaaacgttnttaaggttgggtaagggg

SEQ ID NO: 328840 - DNA, 615 bp, Homo sapiens
  misc_feature: GZ8MTXP01D2VRQ.51.76.G10.1.454.CMB.2.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaangcccacctctcctgcacgggccagtcagagtgtagcagcgacttagccctaggtaccagcaagaaacctggccaggcctccaggcctcctcatctatgatgacactaccacgaggcccagtgatactccgagccgtaggttccaggtggcgtaggtcggggtcgtgggacaggtagttccactctacacatcgaagcacgtcctgtacgtagttctaggtaatttagtttacgaactttaacttttagttaccgtgttaacgacggtataaggttaactttaaacgtaaccgttcgggtacccttaccggttaaccttcggttttccgggacccggttaacgggggtaacccagggtacgtaggaacgttacgaaaccgtaaaggtaccgtggttacggcgttacaaccgttaactaacg

SEQ ID NO: 328841 - DNA, 745 bp, Homo sapiens
  misc_feature: GZ8MTXP01DJ8EG.51.76.G10.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccagcccgggagtccctgagactctcctgtgcagcctntggattcacttcagtgcctatggcatgcacgtcgggtccnccgaggctccgaggacgaagggggctggagtggggtgctatttacatcagtatgagtggactaaagtaaataaggagtagtgactaaggttccgttaccgggtagggaaacgggggtccctaatttacccgaaccctaacgttacccgtacccgaaagggtaaaccgtaaacccttaaaacgtttaccccccaaaaggaaaacccctaacctaaacggtttacggtttaaacgttaaccttacggaaacctaaaaagttacggaaaaccgtaaaggttacgttaagggtaacggaacgggtaccgttaaaggggaacgggttaaacccggtaaccggggttcgtttagggtttacgtttaacgttttccggttagggtttaaccggaaccggtaaaacggttcggttaaaggttcggggttaagggggtttaaggggggttaaaggggg

SEQ ID NO: 328842 - DNA, 543 bp, Homo sapiens
  misc_feature: GZ8MTXP01AMMCR.51.76.G10.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttnagtgcctatggcatgcacgtgggtcccncaggcctccgagggcgaagggggctgggaggtggggtgctagttttanatcagtatgatggacaagtaaataaagagtatgcagtctcgtgaaggcatcacatctacagacgacaacttcccaagaacactactgtactaccgtagacaaagtacgaaatagtattaggaagaagcgttaggacggacgtacgggtcttgttgttactttcgtggtaacgacgtaacgttgtaagttggtaagggg

SEQ ID NO: 328843 - DNA, 541 bp, Homo sapiens
  misc_feature: GZ8MTXP01DZCAR.51.76.G10.1.454.CMB.2.raw
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctcctgcatagtattggatacaactattgattggcactgcagaagccagggcagtctccanaggtcctgatctatttgagttctagtccccgggcccccgggtctgacnggttcagtggcagtggatcgaggcacagtatttanactagaaatcagcagagtggagcgtagaggtagttgggtttacggggtttatgtagttcgntagtgctaagtcctactaacaaaccttcttacgtacgttacgttcgggacgggacgggttaccaaggggttcgggaataacgtacgaacggacgtaacgttgggtcggg

SEQ ID NO: 328844 - DNA, 696 bp, Homo sapiens
  misc_feature: GZ8MTXP01D33H5.51.76.G10.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggcccgggagtccctgagactctctgtgcngcctntgattcacttnagtgctanggcatgcacgtcgggtcccncgaggcctaccgaggacgaagggggtctgggggaggttgggggtagtcttattttagatcgaagtataggagtacgggactaaaagtaaataagggngttaagtggaccgtacggttccgttaccggggtaagggaaccggggtcctaacttaccaacctacgttaccgtaacccgaaggtaacgtaaaccctaaaccttaaccccgaaagtaaaccctaacgtaacggttacgttaacttacccgtaaggtaaacctaaaagtacgtaaacgtaagtaagttagggaacggtagtccggtaaaggaccggttacgtaccggttgttacggttagtttacgtttggttacggtaacgtaacgtaacgtgtaagggttggtaagggttaaggggttaagggg

SEQ ID NO: 328845 - DNA, 536 bp, Homo sapiens
  misc_feature: GZ8MTXP01CEDND.51.76.G10.1.454.CMB.2.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctctgcatagtattgatacaatnttggattggcactgcagagcagggcagtctcanaggtcctgatcttattgagttctaacgtcccccggggccccgggtctgactaggttcagtggctaggtgatcgaggcactagtattttanactagaaaatcgaagacgagtagggtggaaggcgtaggtaggtaggtttgggtttacggggtttancgtagttgctagtgactagtctactaacaactcttactacgcgttcgggcggacggcgaagggtggactaagtacgaaggcgtaacgttcggtaagg

SEQ ID NO: 328846 - DNA, 667 bp, Homo sapiens
  misc_feature: GZ8MTXP01BJHMU.51.76.G10.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgacgactctcctgtgcacgcctctggacttcacccttnagtgcctagtggcatcgcacgtgggtcccncctaggcctccgaggcgaagggggctgggagtgggtggctatttatctcagatgactgggactaaggtaaataaaggngtatggacgtacgttccgtacccggttagggaaacgggtcccgtaacgtttcccaaccctaacgttcccgttaacccgaaaggaacgaacctaaaccttacccccgaaagtaaccaacgtacttacggttatccgtagaacctaaaagttacggaaacctagggtaaacttacgggaaaggaacggtccgttagggaaaccgggttacgaccggggtacttagggttcgtttatttccgggtagtaacggacccggtaaaacgttcgttaagttggggttaaggggg

SEQ ID NO: 328847 - DNA, 589 bp, Homo sapiens
  misc_feature: GZ8MTXP01B7PSW.51.76.G10.1.454.CMB.2.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (485)..(485): a, c, t, g, unknown or other
  misc_feature (485)..(485): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttcctcgttagctctttaagaggtgtccagtgtcaggtgcagctggtggagtcgtgggggagcgtggtccaggcccgggaggtccctgagactctcctgtgcagccctntggattccacccttcagtcgcctagtggcatgccacgttcgggcccncccgaggcctacccgagggaccgaagggggtcttagggggtaggtgggtcgtacttagtttatacgtcgagtagtgacgtaggaactaagttaaataaaggtgtagtcgacgtacgttccgtacggtaggtaaccggtctacttaccaacctactaccacgaagacaactaactacccaanaacactacgtatactactagacaagtagatagtagtagagaagcgagacgacgtacgtcgttgttgttgttgtgtaacgacgtacgttagtaagttggtaaggg

SEQ ID NO: 328848 - DNA, 536 bp, Homo sapiens
  misc_feature: GZ8MTXP01BTD6O.51.76.G10.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccggggaggtccctgagactctcctgtgcagcctctggattccaccttnagtgcctatggcatgcacgtgggtcccnccaggcctccgaggcgaagggggctgggagtggggtgctatttanatcagatgatggacaaagtaataagagtangcagtctcggtagacgggctatcactntctacagagacaacttcccaagaacacgactagtatcctagacaaagtgaacagtatganagctggaaggacacgggctggttnttagtttcnggttcacggaaacgtgtagttgggtaaggttgggggtaagggg

SEQ ID NO: 328849 - DNA, 548 bp, Homo sapiens
  misc_feature: GZ8MTXP01DU8CE.51.76.G10.1.454.CMB.2.raw
  modified_base (277)..(277): a, c, t, g, unknown or other
  misc_feature (277)..(277): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggtgatcaggactcctcagttcaccttctcacaatgaggctccctgctcagctcctggggctgctaatgctctgggtctctggatccagtggggatattgtgatgactcagtctccactctccctgcccgtcaccctggagagccgcctcatctctgcaggtctagtcagacgcctctgcatagtatggatacactattgattggcactgcagaagccaggcagtctcanggtctgatctatttgattctaacgtcccgggcccccgggtctgacaggttcagtggcagtggatcagggcacagtattttanactgaaaatcaagcagagtggaggctagaggagttggttcggggtttaanctaagtttgctatagtacgtaagtactacctaacctaaacctacccttaccttaacgttacgtttacgggtacggggttacggggaccggaaacgggtaagggtaaggaagtacgaacgacgtaaccgttaacggtggg

SEQ ID NO: 328850 - DNA, 566 bp, Homo sapiens
  misc_feature: GZ8MTXP01ARJZA.51.76.G10.1.454.CMB.2.raw
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccagggcagtctccacnggtcctgattctatttgagttctaagtcccccggggcccccgggtctgacaggttcagtgcagtggatcaggcacagtatttanactagaaatcagcagagtgggagngtaggtaggtagggttgggtttaggggtttatacgtagttgacgtagtacgactaacgtaccttactaacctaaaccttccttacgtacggttaccggtttaccggggacgggttaacgggaccgttaagggtaaggagtaacgtacgaaggaccgtaacgttggtcg

SEQ ID NO: 328851 - DNA, 506 bp, Homo sapiens
  misc_feature: GZ8MTXP01B0GX4.51.76.G10.1.454.CMB.2.raw
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccgcctccatctcctgcaggtctagtcagagcctctgcatagtatggatacaatattggattggcactgcagaagccagggcagtctcacaggtcctgatctatttgagttctaacgtccccgggcccccgggtctgacgagttcagtggcaggtggatcgaggcacagtatttanactagaaatcagcagaggtggagntaggaggtagttcggttggggttatgattgctatgactaagtctactaacaaactccttagtagcgtttcggacggacgggccgaaggtggagngtacgagcgtaacgttgtcg

SEQ ID NO: 328852 - DNA, 568 bp, Homo sapiens
  misc_feature: GZ8MTXP01DOO6S.51.76.G10.1.454.CMB.2.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (389)..(389): a, c, t, g, unknown or other
  misc_feature (389)..(389): n is a, c, g, or t
  modified_base (464)..(464): a, c, t, g, unknown or other
  misc_feature (464)..(464): n is a, c, g, or t
  modified_base (519)..(519): a, c, t, g, unknown or other
  misc_feature (519)..(519): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcacgtggggtcccnccagggcctccgagggcgaagggggctgggaggtggggtgactagtttatatcgagtatgaacgtgggacaaggtaaataaaggagttanggcaaggttcctccggtagaacgggccgattccacctatcctaccaggacacaacttacccaagaacactacgtntactactgaacaaagtacgaaataggtatgaagaagcgttaggaggacgacggtnttgttggttatttcgtagtcgacgtaaacgttgtaagttggtaaggggg

SEQ ID NO: 328853 - DNA, 575 bp, Homo sapiens
  misc_feature: GZ8MTXP01EYMJC.51.76.G10.1.454.CMB.2.raw
  modified_base (367)..(367): a, c, t, g, unknown or other
  misc_feature (367)..(367): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctgattcaccttcagtgcctatggcatgcacgtgggtccgccaggcctccgaggcaagggggctaggaggtgggtggctatttatatcagatgagtgcaaagtaaataagagtangctagtctcgtagaggcgattcgacatctaccaagtacgaacaacttacccaagaaacacacgtgttaatctagacaaatcgaaatagtagttagagaggcgtaagaacggacgaacggttcgttaggtgtttacgtttcgttcggttaaggaacccgtaaaaccgtcgttaaggttagggtaaggggttaagggggtttaaaggggg

SEQ ID NO: 328854 - DNA, 573 bp, Homo sapiens
  misc_feature: GZ8MTXP01CVY3K.51.76.G10.1.454.CMB.2.raw
  modified_base (248)..(248): a, c, t, g, unknown or other
  misc_feature (248)..(248): n is a, c, g, or t
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctctgcatagtatgatacaatnttggattgcactgcagagccaggcagtctccanaggtcctagatcttatttgagtttactaacgtcccccggggcccccgggtctgacgtaggttcagtggcaggtggactgaggtcanagttattttanacttagaaatcgagacagagtggagngtaggaggtagttgggtttaggggtttaancgtaagttgacgtagttacggacaagtccttaacctaaactaaaccttccttacgttaacggttacgtttaccggggacgggttacgggaaccgttaagggtaaggaagaacgtaccgaagacgtaacgttggtccggg

SEQ ID NO: 328855 - DNA, 569 bp, Homo sapiens
  misc_feature: GZ8MTXP01EBL5P.51.76.G10.1.454.CMB.2.raw
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (431)..(431): a, c, t, g, unknown or other
  misc_feature (431)..(431): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctctgtgcagcctctgattcaccttcagtgcctatggcatgcacgtgggtcccncaggcctccgaggcgaagggggctgggaggtgggtggactatttanatcagatgatggacaaagtaaataaggagtactgctagtctcggtagaacgggctatcgacatctacagacacaacttacccaagaaacncaacgttgtatactacgactaaaatgaaactagtattagaagtacgcgtaaggaacggacgacgggttcgttagttagttagtttcttaggttcgacggtaaacgtgtaagttaggtaagggttaaggggttaagggg

SEQ ID NO: 328856 - DNA, 654 bp, Homo sapiens
  misc_feature: GZ8MTXP01AQ5VL.51.76.G10.1.454.CMB.2.raw
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggggagaggagccccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgactctcctgtgcagcctntgacttcacttnagtgcctagnggcatgccacgtcgggtcccncgaggcctccgaggccgaagggggtctgggagttggggtgacttaagtttanagtcgaagtatggagtggaactaaaaggttaaataaggtagttatcggaccgtaaggttcccgtaccgggtaagggaaccggggtccctaagttacccaactacgttccctaccgaagtacgaacctaaccttaccccgaaagaaacctactacggttacgtaacttccgtagaaacctaaagtcgaaacgtagtagttaggaacgtagtcgtaaggaacggttaccgtacggttcgttagttgttacgtttcgaggttaacgaacgtaacgtgtagttgggtaaggttaaggggtaaggg

SEQ ID NO: 328857 - DNA, 576 bp, Homo sapiens
  misc_feature: GZ8MTXP01DHKGR.51.76.G10.1.454.CMB.2.raw
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagtcctctggacttccaccttcagtgcctatggcatgcacgtcgggtcccnccaggcctcgaggcgaagggggctgggagttgggtgctagttttaanatcagatagagtgaataaaaagtaaataagagtancgactagtccgtacggaggacggctataccactactaccacgaagacaactaactaccaaacacactacgtatactcagaactaaagacgaaatagtatagaagacgngtaaggaacgacgtacggttagttggttattagtttcgttagtaacgaacgtaacgtgtagttgggtaagggttaaggggtaaggg

SEQ ID NO: 328858 - DNA, 548 bp, Homo sapiens
  misc_feature: GZ8MTXP01BORLS.51.76.G10.1.454.CMB.2.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (515)..(515): a, c, t, g, unknown or other
  misc_feature (515)..(515): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagctctctgtgcagcctctggacttcaccttcagtgcctatggcatgcacgtggccncaggctccgaggcaaggggctggagtggtgntatttanacnagagtgagtagagtaagtaaagtaaagtaagtagtagacgtacgtacgtacgtacggaacggacgtactactaccactactacacgaacgaacaactaccaacgaacgaactactagtactactagaacaaataagaataagtagtagagaagagagagacgacgtcgttgttgttattntagtaacgacgaacgttacgtaagttggtaagg

SEQ ID NO: 328859 - DNA, 599 bp, Homo sapiens
  misc_feature: GZ8MTXP01AQDZV.51.76.G10.1.454.CMB.2.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
  modified_base (419)..(419): a, c, t, g, unknown or other
  misc_feature (419)..(419): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgtacttagcctggtaccagcagaacctggccaggctcccgaggcctcctnatctatgatgcataccacgacgggccatgatactccagccgtaggttcagtggngaggtgggtcgtgggactaggtagttccacgtcacacactcgagcacgcctgcgtagtctagtaacgttagtttanacttaactttaggtacttgtaccaggtactaagtaattaacgtaaccgtcggtacccttacgtacgttcgtttaacggacccgggttaacgggggtaccacggtcggttacggaacgttaccttaaccgaaaacggtacgtttaacgggcgggtacttaccggtaacccgttaacgttcg

SEQ ID NO: 328860 - DNA, 539 bp, Homo sapiens
  misc_feature: GZ8MTXP01EAQAA.51.76.G10.1.454.CMB.2.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
  modified_base (504)..(504): a, c, t, g, unknown or other
  misc_feature (504)..(504): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcagggtncagctggtggagtcgtggggggagcggtggtccaggcccgggagtccctgagctctcctgtgcagcctntggattcaccttcagtcgcctatggcatgcacgtcgggtcccncaggcctccgaggcgaagggggctgggagtgggtgctagtttanatcagatgatggactaagtaaataaagntatgcagtcncgtgaggcatcacatctacaganacaactccaagaacactactagtactctacgactaaatagaaactagtattagagaagcgttaggacggacgacggtgttggttgttacgtttcgnggtcgaacggtaaacgttgtaagttgggtaagggg

SEQ ID NO: 328861 - DNA, 659 bp, Homo sapiens
  misc_feature: GZ8MTXP01AC5YL.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccgagcccggggaggtccctgagactctcctgtgcagcctctggtattcaccttcagtgcctatggcatgcacgtcgggtccgccgaggcctccgagggcgaaggggtcgtgggagtcggggtaggtctagttatactcagatgagtacgggactaagtaaataaacggagttaagtgactacgttcgtcccgggaggtaaacggggccctaattcccacccaagttcctaccaaaggaacgactaaaccttaccccgaagaaaaccctcgtaacctttagtaacctaccgtaaacgaactaaaagttacaaacgtaagtaagtaggtaaggtaacggtaacggttacggtacggaacggtaacggtacgttacggttcgtttacgtttaacgttacggtaacggtaacggtaacggttacgtaacggttaagggtaaggg

SEQ ID NO: 328862 - DNA, 503 bp, Homo sapiens
  misc_feature: GZ8MTXP01DSEJR.51.76.G10.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttnagtgcctatggcatgcacgtgggtcccncaggcctccgaggcaagggggctgggagtgggtgctatttanatcagatgatggacaagtaaataaagagtatgcagtcncgtagagggcatcaccanctacagacacaactcccaagaacacactgtatcngacaaatgaacanatagagaagnttgagacgacgngttgttgttattntgtgacgaacgactaagttgtaaggg

SEQ ID NO: 328863 - DNA, 573 bp, Homo sapiens
  misc_feature: GZ8MTXP01ER5MM.51.76.G10.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
  modified_base (542)..(542): a, c, t, g, unknown or other
  misc_feature (542)..(542): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagtcttgggtttttcctcgtttgcttcttttaagaggtgtccagtgtcaggtgcagctgggtggagtcgtgggggagcgtggtccaggcccgggagtccctgagtactctctgtncagcctntgattccacttnagtgcctagtgcatcgcacgtgggcccncaggcctacgaggcgaaggggctggaggtggtgactatttanatcagtatgagtggataaaagtaaataagagtangctagtctacgtaggacgcgtatacactatctaccgagacactaacttaccccaagtaaccactacgtgtataccgtagaaccaaatgaaactaagtatagacgtaagcgtaaggacggttacgacggttgttagttagttgttcgttgtaacggaacgtaacgtntaggttaggtaacgggttaagggttaagggg

SEQ ID NO: 328864 - DNA, 503 bp, Homo sapiens
  misc_feature: GZ8MTXP01BL02D.51.76.G10.1.454.CMB.2.raw
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttnagtgcctatggcatgcacgtgggtcccncaggctccgaggcaagggggctggagtgggtgcatttanatcagatgatggacaagtaaataaagngtatgcagtctcgtgaaggcgatcacatctccaganacaatcccagaacacactgtatctgacaaatgaacagtattagagaagcttaggacgacgacggcttagttgttatttcgngtgacgaacgctaagttggtaaggg

SEQ ID NO: 328865 - DNA, 626 bp, Homo sapiens
  misc_feature: GZ8MTXP01BXEIQ.51.76.G10.1.454.CMB.2.raw
  modified_base (200)..(200): a, c, t, g, unknown or other
  misc_feature (200)..(200): n is a, c, g, or t
tcagcgatcgtatacacgaccggtgctcgattttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgattagcctggtaccagcagaacctggccaggcctccagctctcatcatgatgcatccagtaggccatgactactcccgagcctagggttccaggtggaccgtaggttcgggtacgtcgggggacaggtaacgtttcccacttccgtcaacctatcagcacgtcctgaccgtagtcgtaggtaagttatttacgtacttaaattttacgttaacttgtacctagtacgtaagttaaataagttaacgtcggtacccttaccgtacgttcggtttcggacccggttaacggggtaccgttaaaggtccgttaagggaacgttacgttaacccggtaaaacgtaccggttaaggttcgggaccttacggaaccgttaaccgttaaccg

SEQ ID NO: 328866 - DNA, 548 bp, Homo sapiens
  misc_feature: GZ8MTXP01CPFHE.51.76.G10.1.454.CMB.2.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (530)..(530): a, c, t, g, unknown or other
  misc_feature (530)..(530): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggtcccgccaggctccgaggcgaagggggctgggagtgggtgctatttanatcagntgatgggacaagtaaataaagngtatgacagtctccgtaggaacgggccgattcaacctatcctccagagacaacttcccaagaacacacttgtatcctgactaaatgaactagattaggagaagcgttggacggacgtacggtcttggttgtttacgtttcgtggtcgaacggtaaaccgttnttaaggttgggtaagggg

SEQ ID NO: 328867 - DNA, 584 bp, Homo sapiens
  misc_feature: GZ8MTXP01CY2DT.51.76.G10.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (471)..(471): a, c, t, g, unknown or other
  misc_feature (471)..(471): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcacgtgggcccncgaggcctccgaggcgaagggggctgggagtggggtgactatttanatcagatgatggacaaaagttaaanaaggtgttangacctagtctaccgggtaggacgccgatcacctatcacagacaacaacttaccaagaacacacgtagtactctagaactaaatacgaataaaggtnttaggaagtacgacgtaagggaaacggaccgtacggcgtttaggtcgtttagtttcgttaggtaacgaaaccgtaacgtcgtaggttagggtaagggttaaggggttaagggg

SEQ ID NO: 328868 - DNA, 788 bp, Homo sapiens
  misc_feature: GZ8MTXP01CQM7Y.51.76.G10.1.454.CMB.2.raw
  modified_base (256)..(256): a, c, t, g, unknown or other
  misc_feature (256)..(256): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcacgtgggtcccgccagggcctaccgagggccgaaggggggtccttagggggaggttgggggtcggactaagttttatactcgaagtattaggagttacggggactaaggttaaaataaaaagggagttaatcggactaagggttcccttacccgggttaggaaacggggtcccgtaatttacccgaacccgtaacttaccgtaccccgaaaggaacgtaaaccctaaaacctttacccccgaaacggtaaacccgtaaaccctaacgtttaacggttaaacctttaccttaacggtaaaccctaaaaagttaacggaaaacctaaaggttaaacgtttaacgggaaaggtaaacgggtaaccggttaaggggtaaacggggaaacccgtaaaccgggggttccgtttaggggttttacggtttaacgtttttaaccggtacgggtttaacggaacccgggtaaaaaccggttcgtttaaacgggttaagggtttaaagggggg

SEQ ID NO: 328869 - DNA, 554 bp, Homo sapiens
  misc_feature: GZ8MTXP01C0TL4.51.76.G10.1.454.CMB.2.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (504)..(504): a, c, t, g, unknown or other
  misc_feature (504)..(504): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagactctcctgtgcagcctctggattccaccttcagtgcctatggcatgcacgtgggcccncaggcctcgaggcgaagggggctggaggtgggngctatttanatcagatgatggactaaagtaaataagctagtgactagtcgtaccgtaggaacggcgtatcactatctacagacacaattacccaagaacacatcgtatctagacaaatgaactagtatgaagacgcgtaaggaacggacgtacggcttggtagtttagttttcgnggttaacgaagtaaccgtgtagttagggtaagggttaaggggttaagggg

SEQ ID NO: 328870 - DNA, 550 bp, Homo sapiens
  misc_feature: GZ8MTXP01EUM2O.51.76.G10.1.454.CMB.2.raw
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctcgtggacttcaccttcagtgcctatggcatgccacgtcgggtcccgcaggcctccgagggccgaagggggctgggaggtgggtgactatttanactcagatgatgggactaagtaaataaagngtatgacagtcncgtagaggcgatcactatctacagacgacaactaccaagaacacgtactagtactctagacaaagtagaaactagtagttagaagaagcgttaggacgacgtacggnttggttgttacgtttgtgtaacgacggaaacgttcgtaagttgggtaaggg

SEQ ID NO: 328871 - DNA, 782 bp, Homo sapiens
  misc_feature: GZ8MTXP01BQG89.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgctctcctgtgcagcctctggacttcaccttcagtgcctatggcatgcacgtcgggtcccgccagggcctaccgaggccgaagggggcgtagggtaggtgggggtagacttaattttacgtactcgaaggtatggaacgttaacgggaactaaggttaaaagtaaaagggtagttagtacggtaccgtaacgggttacccggttaccgggtacggggaaacggggtaccccgtaagtttaaccccgaacccgttaaccttaccccgtaaccgtaaacggaaaccggtaaaacccttaaaccccgttaaaccccaaaaccggaaacccgtaaaccttaacccgtttaggtttaaccttaccgtaacggtaaacctaaaacgttaacggaaaacgtaaggttaagttaacggaaggtaacggttaccgttaaggggtaaacggacccggtaacgggtttccgtttacgggtttagtttaaccgttttggtacggttaacggtaaacccggtaacggttagttaagggttaaggggttaaggggg

SEQ ID NO: 328872 - DNA, 524 bp, Homo sapiens
  misc_feature: GZ8MTXP01A8U49.51.76.G10.1.454.CMB.2.raw
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattccacttcagtgcctatggcatgcacgtgggtcccgcaggctccgaggcaagggggctgggagtggggtggctatttagatcgagatgatggacaaagtaataagngtangcagtcncgtagaggcgatcacatctaccagacgacaacttcccaagacacactgtactctagacaaagtcgaaatagatgagtagcgtggacgacgtacggctgtgttacgtttcgttgtgacgaaacgngtagttggtaagggttgggtaaggg

SEQ ID NO: 328873 - DNA, 626 bp, Homo sapiens
  misc_feature: GZ8MTXP01CHAU6.51.76.G10.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtggagtcgtgggggagcgtggccaggcccgggagtccctgagctctcctgtgcagcctgtggacttccaccttnagtgcctatggcatgcacgtgggccnccaggctccgaggcgaaggggctggaggtggggtnactatttaanactanaaagtgagtacggaaaataaagtaataaagtagtatcgacgtacggtccgtacggtagacggtacctactaccaacctactaccgacgaagaacgaacctaacctaaccgaaacgtaaacctacgtaacgttacgtaactacgtaagtaacgtaaacgtaacgtaaacgaagtaagtagtacgagtaacgtacggacggtaacgttacggtacgttagttagttacgttacgttaacgtacggtaacgtaacgtacgttagtaagggttaagggtaagggg

SEQ ID NO: 328874 - DNA, 565 bp, Homo sapiens
  misc_feature: GZ8MTXP01AL20V.51.76.G10.1.454.CMB.2.raw
  modified_base (197)..(197): a, c, t, g, unknown or other
  misc_feature (197)..(197): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttagcctggtaccagcagaaacctggccaggctcccaggcctcctcatctatgatgcatccacgaagggcccatgatacncccagcctaggttcaggtggcgtaggtcgggtctgggacaggtagttcactctacaccatcagcagcctgactagtcgtagagttatttcgactttaatttagtacttgtacaagtactaaagttataaacgtaacgtcggtacccttacgtactcggtttcggaccgaacggggtaccaaggtcgtaagggacgttacttaaccggtaaaacggtacgttggtcggtcttacgccgttaacctcg

SEQ ID NO: 328875 - DNA, 584 bp, Homo sapiens
  misc_feature: GZ8MTXP01B6AVV.51.76.G10.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaaacctggccaggcctcccaggcctccncatctatgatgcatccacaacgggcccatgatactcccagcctaggttcagtggctaggtgggtctggggacagggtacgttccacgttctaccacctatcgagcacgcctgctagtctagaagttatttgacttaatttattactgtcagtactaagtataaataacgtggtcccttaccgtacttcgtttcggacccgttagggggtaacccaagggtaccgtagggttaacgttaacgttaaccgaaaacgggtaacgttgggttacggaccgttacggtccgttaacccttaag

SEQ ID NO: 328876 - DNA, 534 bp, Homo sapiens
  misc_feature: GZ8MTXP01A2D4X.51.76.G10.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
  modified_base (437)..(437): a, c, t, g, unknown or other
  misc_feature (437)..(437): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctntggattcaccttcagtgcctatggcatgcacgtgggtcccncaggctccgaggcgaagggggctgggaggtgggtgctatttactatcgagatggattagggactaaggtaaataaagagtatgcagtcncgtagacggcgatcactatctcagacgacaacttccaagtaacaactacgtntaacttcagaacaaagtacgaactagattgagaagcaggagacgacggnttggttcttacttcgtagtcgaaccgaagttcgtaagttggtaagggg

SEQ ID NO: 328877 - DNA, 497 bp, Homo sapiens
  misc_feature: GZ8MTXP01BEU5X.51.76.G10.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (333)..(334): a, c, t, g, unknown or other
  misc_feature (333)..(334): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgcccgtcacccctggagagccgcctccatctcctgcaggtctagtcagagcctctgcaatagtattgatacaatattggattgcactgcagagcgaggcagctcanagtcngatctattgatctaatcccggccccggtcngacagtcagtgnagngannagnanatattatananaananananagagagagagagagaggtgttaggttagtatagtgacgatagacgtagtactactaactaaactaccttactacgttacgtacggtacggacggacggaacggtaaggagaacgtacgaacgaacgtaacgttaagtg

SEQ ID NO: 328878 - DNA, 781 bp, Homo sapiens
  misc_feature: GZ8MTXP01EFXBI.51.76.G10.1.454.CMB.2.raw
  modified_base (187)..(187): a, c, t, g, unknown or other
  misc_feature (187)..(187): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccagcccgggagtccctgagactctctgtgcagcctctgattcaccttcagtcgcctagtggcagtcgcacgtcggggtccccnccgagggcctccgagggacgaaggggggctaggggacgttggggtcggacttattttanacgttcgaacggtagttaggaagtcggggaactaaaaagggttaaaataaagggagttaacgtggacctaacgggttccgtacccggggttaagggaaacgggggtcccgtaactttacccgaaacctacttacccgttaacccgaagggtaaaccgaaacctaaaccgttacccccaaaaggtaaaaccaacccttaaccgggtttagttaaacttaccgttaaggaaacctaaaagttaccgaaaacgtaaggtaactttagggaaacggttaaggaccggttaagggaaacgggaaaccggtaaccgggttcgtttacgggttaacgttttaagttttccgttagggtttaaccgggaacccgtaaaacgggttcgttaagggttagggtaacgggggtttaagggggtttaaaggggg

SEQ ID NO: 328879 - DNA, 613 bp, Homo sapiens
  misc_feature: GZ8MTXP01AHM96.51.76.G10.1.454.CMB.2.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtctccactctccctgcccgtcacccctggagacgccggcctccatctcctgcaggtctagtcagacgcctcctgcatagtattggatacaactatttggattggcacctgcagaacgccgagggcagtcncgacnggtcctgatctatttgagttctaacgtccccgggcccccgggtctgacgaggttacagtcggcaggtggactcgaggcactagtatttanactagaaatcgaagcaggagtgggagtcgtaggtaggtacgtttggggtttaggggtttaancgtaagttggactagttcggactaaaggtccttaacctaaaccgtaaaccttcccgttactaacgggttaaccgtttccgggggaacggggttaacggggaacccgttaaagggggttaacgggaagtaacgttacccggaaaggacccggtaagttcgggtcggg

SEQ ID NO: 328880 - DNA, 558 bp, Homo sapiens
  misc_feature: GZ8MTXP01BBJM0.51.76.G10.1.454.CMB.2.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (441)..(441): a, c, t, g, unknown or other
  misc_feature (441)..(441): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagctctcctgtgcagcctntggattcaccttnagtncctatggcatgcacgtgggccnccaggcctaccgaggcgaagggggctgggaggtgggtgctatttatactcaggtatgatggactaagtaaataaaggatatgcagtctaccgtagacgggccattccacgatccacagacacaactacccaagaacactagtctanctagaacaatacgaactaagtgttagagtaagcgttagggaacggacgtacgggttnttggttcgttactttggtaggtaacggtaacgtaacgttcgtaagggttgggtaaccggg

SEQ ID NO: 328881 - DNA, 608 bp, Homo sapiens
  misc_feature: GZ8MTXP01AMVP8.51.76.G10.1.454.CMB.2.raw
  modified_base (169)..(169): a, c, t, g, unknown or other
  misc_feature (169)..(169): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtgggtccaggcccgggaagtccctgagacctctcctgtgcagcctctggattccaccttcagtcgcctagtggcatgcacgtcgggtcccncgaggcctccgaggcgaagggggctgggaggtgggtgctatttanatcagatgatggacaaagtaaataagagtatgactagtcctacgggtaggaacgggtccgtattccaacctactacctaccgaagaacgaacctaacgttacccaagaaaccactacgtgttaactctagaacctaaagtagaaacgtaagtagttagaaggacgcgtaaggacgggaccgtacggttcgttaggttagtttacgtttcgttggtaagaccggtaacgtgtaggttagggtaaggggttgggttaagggg

SEQ ID NO: 328882 - DNA, 650 bp, Homo sapiens
  misc_feature: GZ8MTXP01AFZA1.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcacccctggagacgcccggcctccatcctcctgcaggtctagtcagacgccctcctgcatagtattggaatacaatattggattggcactgcagaacgccgagggcagtcctccacgtacggtcctagattcttatttgacgtttccgtaaccggtcccccccgggggtccccccggggtcctaggaaccgtacgggtttaccgaagggttcggacgtagggtgggtactccggaagggtcctaaacgtagtttaattttaactaacgttaagaaaacttcgaagacgaaggtaggtagggagtgtaggtagggtaggtttcgggtttaggggtttatacgtaagtttcgacgtagttacgactaacgtctaaccttaacctaaaccttccgttacgttacggttaaccggtttcggggacgggacgggaccgaagggtaaggagaagtacgagcgtaacgttggtaacg

SEQ ID NO: 328883 - DNA, 586 bp, Homo sapiens
  misc_feature: GZ8MTXP01B38SJ.51.76.G10.1.454.CMB.2.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (536)..(536): a, c, t, g, unknown or other
  misc_feature (536)..(536): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggcccgggagtccctgagactctcctgtgcagcctctggattccaccttcagtcgcctatggcatgccacgtcgggtcccnccgaggcctccgagggcgaagggggctgggagtgggtgctatttanatcagatgatggactaaagtaaataagntactgactagtctcggtagaacgggtccattcactatctaccgaagacgaactaacttcccaaagaacaccagttgtaactctagacaaatgaaactaaggtattaggaagacgtcgtaagggaacggttacgaccggttgttaggttgtttagtttcgnggttaaggaccgtaaacgtgtagttagggtaaggggttggggttaagggg

SEQ ID NO: 328884 - DNA, 639 bp, Homo sapiens
  misc_feature: GZ8MTXP01ESR1G.51.76.G10.1.454.CMB.2.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
  modified_base (414)..(414): a, c, t, g, unknown or other
  misc_feature (414)..(414): n is a, c, g, or t
  modified_base (576)..(576): a, c, t, g, unknown or other
  misc_feature (576)..(576): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtcctccgaaggggaaanacgcccacccctntccgtgccgagggccagtcaggtagtgttagcagcgtacttgcctggtaccagcaagaacctggccaggcctccgagcctcctnatctangatgactncccgaaacgacggccctaactgactacnccccgagtcccgtaaggttccaggtggacgtagggtcggggtctaaggggaccagggtacttccactttccacnctaactcgacgcgacgtcctgaccgtgtactagtaagttacgtttagtacttaattttaacgtcttggttaccgagtaacgtaaagttaacttaaacgttaccgtacggtacctaccgttacgttacggtttcgggaccgttaaggggtaccaggtacgtanaacgttacgttaaccgtaaacgtcgtaacggtcggtaccgttacgtaaccgttaaccgtaacg

SEQ ID NO: 328885 - DNA, 545 bp, Homo sapiens
  misc_feature: GZ8MTXP01COJ0G.51.76.G10.1.454.CMB.2.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggtcccncaggctccgaggcaagggggctgggagtgggngctatttanatcagatgatggcaaagtaaanaagntangacagtctcgagaagggcattcacatctcagacacaattcccaagaacacacgttagtactctagactaaagtgaaacagtacttaggaacgagcgtaaggaacggacgacggttcgttagtagttactttcgttaggtgaacgtaaaccgtgttagttgggtaagggttggggtaagggg

SEQ ID NO: 328886 - DNA, 552 bp, Homo sapiens
  misc_feature: GZ8MTXP01CJZ2C.51.76.G10.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagctctcctgtgcagcctntggattcaccttcagtgcctatggcatgcacgtgggtcccncaggctccgaggcaagggggctgggagtgggtgctattttanactnagtatgagtaggactaagtaaataaagngtangactagtccgtacggtaggacggcctatccacctatccacaagacactaactaccaanaacactactntactctagacaaatagaactagtagtagagtaagcgaggacggacgtacggtcttaggttgttacgttgtaggtaacggaacgtaacgttacgtaaggttgggtaaggg

SEQ ID NO: 328887 - DNA, 581 bp, Homo sapiens
  misc_feature: GZ8MTXP01AO5U8.51.76.G10.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (391)..(391): a, c, t, g, unknown or other
  misc_feature (391)..(391): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaaacctggccaggcctccgaggcctcctnatctatgatgacatccaagaggccatgactactcccagtcctaggttcaggtcggcgtaggtgggtccgtggggaacaggtacgttccacttcctacaaccctntcgagcacgcctgctagtctaggtaacttatttgactttaaatttcttacgttgtcaagtctaagttaataacgttaaccgtcgtacccttaccgttaattccggtttcggggacccgttaagggggaacccttaaggccgtaagggattacgttaaccgtaaacgacgttggagtccacgccttcgtcg

SEQ ID NO: 328888 - DNA, 664 bp, Homo sapiens
  misc_feature: GZ8MTXP01EJN9U.51.76.G10.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgtacttagcctggaccagcaagaaacctggccaggcctccaggctccncatcatgatgcatacccaacgaacggccctactgatacctcccagccctaggttcaggtggcgtaggtgggtctgggactagacgttcacctctacaccatcacgcgacgcctgacctagtcgtaggtaacttagtttacgaactttaaacgtttttaagtttaacgttggttacctaacgggtaacttaaacggtttaaatttaaaacgttaaaccggttccgggttaacccctttaccggttaacccgtttacggttttaaccgggggaaccccgttaaaggggggaacccttaaagggtccgtaaggggttaaacgttacggttaaaccgtaaaacggtacctgggttacgggcttacggaacccttaacttaacg

SEQ ID NO: 328889 - DNA, 539 bp, Homo sapiens
  misc_feature: GZ8MTXP01AGQ9W.51.76.G10.1.454.CMB.2.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
  modified_base (500)..(500): a, c, t, g, unknown or other
  misc_feature (500)..(500): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtcgcctatggcatgcacgtgggtcccnccaggcctccgaggccgaagggggctgggaggtggggtgctatttanatcgagtatgatgggacaagtaaataaagngtatgactagtctccgtagaacgggcctattccacatcctacagacgacaactcccaagaaccactacgtgtactctagacaaagtcgaactagatgaagaacgcgttaggacggaccgacggtnttggttcttagttcngtgacgaacgntaagngtaagggg

SEQ ID NO: 328890 - DNA, 589 bp, Homo sapiens
  misc_feature: GZ8MTXP01CWJA7.51.76.G10.1.454.CMB.2.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgacgactctcctgtgcagcctctggattcaccttcagtcgcctatggcatgcacgtgggtcccnccaggcctccgaggccgaagggggctgggagtggggtgactatttanatcagatgatggactaaagttaaataaggngtatggactagtccgtcgtaggaacgggcctattccaacctatcccgtaccagaacgaacctaacttaccccaaagaaaccacacgttagtactacctagaacaaagtcgaaactaagtattagagagcgtaaggaacggacgacggttgttagttgttacgtttcgttagtaacgaccgtaaagtcgtaggttggtaaggttggggttaagggg

SEQ ID NO: 328891 - DNA, 620 bp, Homo sapiens
  misc_feature: GZ8MTXP01BE3CK.51.76.G10.1.454.CMB.2.raw
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcccgggagtccctgagactctcctgtgcagcctctggattcaccttcagtgcctatggcatgcacgtgggtcccnccaggcctccgagggcaagggggctgggaggtgggtgctatttanatcagatgatggacaaagtaataagngtatgactagtctacggtagaacgggtcctattcacctatcctacccgaaggactaaccaacttaccccgaaagaaaccacctacttacgttaactaccgtagaacctaaaagtacggaaactagtattaggaagtacggcgtaagggaacgggaccgtaacggggttcttagggttgtttaacgtttcgttaggtaacggaccggtaaaccggtcgtaggttagggtaaggggttaagggggttaaaggggg

SEQ ID NO: 328892 - DNA, 612 bp, Homo sapiens
  misc_feature: GZ8MTXP01BWD6T.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatctcctgcaggtctagtcagacgccctcctgcatagtatggatacaactattggattggtacctgcaggaacgccgagggcacgtctccacgtacggtcctgattcttatttggacgtttcctaacggtcccggggtcccccccccggggtcctgacgtggttcaacggtggcaggtggatcgaggacacgtagttattttacgaactagaaaactcgagacgtaggtaggtagggacggtagtagggtaggttaggtttggggggttttagggggttttaactcgtagtttggactagttggacaagtcctactaacctaaacgttccttacgttacggtacgttcggggacgggtacgggaaccgttagggttgaagtagtaacgaagcggttacgtggttcggtc

SEQ ID NO: 328893 - DNA, 606 bp, Homo sapiens
  misc_feature: GZ8MTXP01EYL14.51.76.G10.1.454.CMB.2.raw
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (576)..(576): a, c, t, g, unknown or other
  misc_feature (576)..(576): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagtctgggttttcctcgttgcttcttttaagaggtgtccagtgtcaggtgcagctggtggagtcgtgggggagcgtggtccaggcccgggagtccctgagtactctcctgtncagcctctggacttccaccttcagtcgcctagtggcatcgctacgtcgggtccccnccgaggcctaccgaggcgaagggggtctgggaggtggggtgactagtttanatcgagtatagagtaggaactaaaaagtaaataagtagtaagtcgacgtaggtccgtacgggtaggacggtcctatccactactactacgaagaacaacctaacctacccaaagaaccactacgtatactcaagaacaaagtacgaanagtagtagagacgngaaggacggacgtacggttgtagttagttactttcgttaggtaacgacgtaacgttntaggttagggtaagggttaaggggtaaggg

SEQ ID NO: 328894 - DNA, 633 bp, Homo sapiens
  misc_feature: GZ8MTXP01D10T8.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctgtggacttccaccttcagtcgcctagtggcagtcgcctacggtcgggtccccgccgaggcctcccgagggccgaagggggtctgggagggttgggtcgactatttatactcgaagtagtgagtacgggataaggttaaaataaagtacgttatcggacctaggttcccgtaccgggtaggaacgggtcctaattccaacctactcctaccaaggaacaacctaacttacccaaagaacctaactacgttagtactactagaactaaatacgaactaagtagttagaagtaagcgttaggaacggacgtaaccggtcttggttacgttacgtttcgtaggtaacggtaacgaaacggttcttaaggttggtaaggggg

SEQ ID NO: 328895 - DNA, 685 bp, Homo sapiens
  misc_feature: GZ8MTXP01CUJSB.51.76.G10.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccaccctctccgtgcgagggccagtcagagtgtagcagcgacttagcctggaccngcagaacctgccaggctccgaggctcctcattctatgatgactactaccgacaacgggcctacgtgaacttactacccccgagtacccgtaagggtttccagggtcggtcgaaggggttcggggtctgggggaaacctagggtacgtttcaacgtctacaaccgatcgacgacacgccttagaccgtaagttccgtaaggtaaacgttacttttaaggtacctttaaaagtttttacgttaacgttacggttacctaagtaccgttaaagttaaacttaaacgttaaaccgtcgggttaccccttaccgggttaacttacggttttaaccgggaccgttaaacgggggtacccttaaacgggtccgtaaggggaacgttaacgttaaccgaaaacggtacgttcgggcggtacttaccgccttaaccgttaac

SEQ ID NO: 328896 - DNA, 578 bp, Homo sapiens
  misc_feature: GZ8MTXP01D26OR.51.76.G10.1.454.CMB.2.raw
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggccccgggagtccctgagactctcctgtgcagcctctggattccaccttcagtgcctatggcatgcacgtgggtcccncagggctccgaggacgaagggggctgggaggttggggtgacttatttanatcgagatgagtggactaaagtaaataaggngtaatgactaggtcctccgggtagaacgggcctattccaactatcctaccgagtacgaacaacttacccaagaaccactaactagtactactagacaaaagtcgaaatagagttcgaagacgngtaagaagacgtacgngttagttgttactttgttagtaacgacgtaactgtagttggtaagggttaagggtaagggg

SEQ ID NO: 328897 - DNA, 594 bp, Homo sapiens
  misc_feature: GZ8MTXP01CWSER.51.76.G10.1.454.CMB.2.raw
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (534)..(534): a, c, t, g, unknown or other
  misc_feature (534)..(534): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtcaggccgggagtccctgagactctctgtgcagcctcgtggacttcaccttcagtgcctatggcatgctacgtggtcccncaggcctacgaggccgaagggggtctgggaggtgggtgactagtttanatcgagtagtagagtacggactaaaagttaaataagaggtancggactacgtcccgttacgggtaaggaacggggtcctaatttccaaccgtataccctacgagtacgaaacctaactacccaagaacactacgttgtaactnagaacaaatcgaanagtntagacgagtcgaaggacgagtaccggttntaggttcgtttattcgttagcgaacgaacgtgtaggttaggtaaggttggggttaacggg

SEQ ID NO: 328898 - DNA, 528 bp, Homo sapiens
  misc_feature: GZ8MTXP01BN4U8.51.76.G10.1.454.CMB.2.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagcccgggagtccctgagactctcctgtgcagcctctggattcaccttcagtgcctatggcatgcacgtgggtcccgccaggcctccgaggcgaagggggctgggaggtgggtgctagtttanatcagatgatgggacaagtaaataaagngtatgcagtctcgtgaagggcatcacatctcaganacataccagaacactactgtatctagacaaatgaacagtatgagaagcttaggacggacgaacgggtcttaggttcgttatttcgtaggttcggaacgaaacgttcgtaaggttggtaaggggg

SEQ ID NO: 328899 - DNA, 561 bp, Homo sapiens
  misc_feature: GZ8MTXP01A7UCG.51.76.G10.1.454.CMB.2.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (489)..(489): a, c, t, g, unknown or other
  misc_feature (489)..(489): n is a, c, g, or t
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaagtgtccagtgtcaggtgcagctggtggagtcgtgggggagcgtggtccaggcccgggagtccctgagactctcctgtgcagcctntggattcaccttcagtgcctagtggcatgcacgtcgggtcccnccaggcctccgaggcgaagggggctgggagtggggtgctagtttatactcagatgatgggactaaggtaaataaagacgtatgacagtccgtacgtaggaacggcgtattccactatcctaccaagtacaacctaacttacccaagaacactaactataactactaaacaatagaaacagtattagaagngcgtagacggacgaccggtagtgttagttatttcgngtaggaacgtaaacgtnttagtggaaggttaagggg

SEQ ID NO: 328900 - DNA, 641 bp, Homo sapiens
  misc_feature: GZ8MTXP01BQ3LF.51.76.G10.1.454.CMB.2.raw
  modified_base (345)..(345): a, c, t, g, unknown or other
  misc_feature (345)..(345): n is a, c, g, or t
  modified_base (573)..(573): a, c, t, g, unknown or other
  misc_feature (573)..(573): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgacgactctcctgtgcagcctctggattcaccttcagtgcctatggcatgcacgtcgggtcccgccaggcctccgagggcgaagggggctgggagtgggtgctaagtttanatcagatggatggactaaagttaaataaggtagtaagtgactagttccgtacggtagggaacgggtcctattccaacctacttaccgtacccgaagtaacgtaaccctaacttacccccgaaagaaacccaacgtaccgttagtaacttccgaggtaaccaaagtagaaactaaggtacgttaggacgtaggccgtaaggaacgggttacgaccgggttgttaggttnttacgtttcgttaggtaacggtaaccgaaacgttgtaggttagggtaagggttaagggggttaagggg

SEQ ID NO: 328901 - DNA, 640 bp, Homo sapiens
  misc_feature: GZ8MTXP01BT8CD.51.76.G10.1.454.CMB.2.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
  modified_base (451)..(451): a, c, t, g, unknown or other
  misc_feature (451)..(451): n is a, c, g, or t
  modified_base (572)..(572): a, c, t, g, unknown or other
  misc_feature (572)..(572): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcggtgggggaggcgtggtccgaggcccgggagtccctgacgacctctcctgtgcagcctgtgacttcaccttnagtcgcctagtggctatgcacggtcgggtcccnccgaggcctcgaggcgaagggggctgggagtgggtgactatttagatcgaagatgagtaggactaaaaagttaaaataaggnttaacgtggacctagttcctacgggtagaacgggctattcccactactcctacaaggtaanaacctaactacccaaagaaaccaccgtaactagttaactcgttaacgaacaaaagttcggaaataagtattaaggagaacgtcgtaaggaacggaaccgtaccgggttacgtttagggttntttaacgttttgttacggtcggaacgaaaccgttgtagttaggggtaacgggttggggttaaaggggg

SEQ ID NO: 328902 - DNA, 595 bp, Homo sapiens
  misc_feature: GZ8MTXP01DLK5A.51.76.G10.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaangccacctctcctgcagggccagtcagagtgttagcagcgattagcctggaccagcagaaacctggccaggcctccgagcctcctnatctatgatgcatccacgaggccatgatactccagcctaggttcaggtcggctaggtgggtctggggactagtacgtttccaccttctccactatcgagccacgcccttgacgtacgttctagtaaagttattttaggaactttaaattttacttaacttggtaccaggtactaagttattaaacgttaaccgttcggtacccttaccgttaacgttacggttttcgggaccggttaacggggtacccttaaagtccgttaggaacgttacttaacgaaacgtacgtggtacggcttagtaaccgaacgtaac

SEQ ID NO: 328903 - DNA, 590 bp, Homo sapiens
  misc_feature: GZ8MTXP01C2UH1.51.76.G10.1.454.CMB.2.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctcatctcctgcaggtctagtcagacgcctctgcatagtattggatacaatattggattggcacctgcagaagccagggcagtctccanaggtcctgtatctattgacttcaacgtccccgggccccgggtctgactagtcagtgcagtgancagcactagtatttagactagaaatcgaagtcagaggtaggacggtntagggaggtagggttcggggttttagggggtttaatacgttaagttgacgtattagggacctaaaggtacctaccttaaaccgtaaacctttccgttacgttaaacggttacggttttacggggccggggttaaaggggttccgaaagggttgggaacgtaagtaccgaaggttacgaaccgttgggtaaccgg

SEQ ID NO: 328904 - DNA, 601 bp, Homo sapiens
  misc_feature: GZ8MTXP01CWQ6L.51.76.G10.1.454.CMB.2.raw
  modified_base (162)..(162): a, c, t, g, unknown or other
  misc_feature (162)..(162): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctnttttaagaggtgtccagtgtcaggtgcagctggtggagtcgtgggggagcgtggtccgacgccgggaggtccctgagactctcctgtgcagcctctggtacttccacttcagtgcctanggnatgcagtggtcccgcaggctaccgaggcgaagggggctgggagtgggtgatatttanatcagatgatacggganaagttaaanaaagngtancgagtacgtcgtacgagacggactatccaactactccacaagacaaactaactaccaaanaaacgtactaagttgtaactacgaacgtaactaaagtaaacgtaaacgtaaagtaagtaagtaaggtaaggtaacgacggtaacggaacggtacggtacgttacgttcgttacgtttaacgttacgtaacgtaacggtaacgttacgtaacggttaaggtaaggg

SEQ ID NO: 328905 - DNA, 584 bp, Homo sapiens
  misc_feature: GZ8MTXP01D6THB.51.76.G10.1.454.CMB.2.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggccccgggaggtccctgagactctcctgtgcagcctctggacttcaccttcagtcgcctatggcatgcacgtgggtcccncgaggcctccgaggcgaagggggctgggagtgggtgctatttanatcgagatgagtcggactaaaagtaaataaggatacgtgactagtcgtacggtaggacgggcctattcacctatctaccagacacaacttacccaanaacactacgtatatcagaacaagtagaaagagtagtagagtgacgtaaggacggacgtacggttgttagttgtttacgtttcgttacggtaacgaacggtaacgtacgttaggttagggtaaggggttaacgggggttaaggg

SEQ ID NO: 328906 - DNA, 551 bp, Homo sapiens
  misc_feature: GZ8MTXP01E109A.51.76.G10.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctctgtgcagcctntggattcaccttcagtgcctatggcatgcacgtcgggtcccncgaggctccgaggcgaagggggctggaggtgggtgctatttanactcgagatgatggactaagtaaanaaagntatgacagtcncgtagacggccatcacatcctacagagactaactcccaagaacacacgtagtatctagaactaaagtacgaaactagtagtaggaagaagcttagggaacggacgtaacggtcttggttgttactttcggagttcggaacggaaaccgttcgttaaggttgggtaaggggg

SEQ ID NO: 328907 - DNA, 649 bp, Homo sapiens
  misc_feature: GZ8MTXP01CA3G8.51.76.G10.1.454.CMB.2.raw
tcagcgatcgtatacacgaccggtgctcgatttagtcactcatacaggggtgatcaggactcctcagttcaccttctcacaatgaggctccctgctcagctccgtggggctgctaatgctctgggtctctggatccaggtgggatattgtgatgactcagtctccactcctccctcgcccgtccaccccgtggacgacgcccggcctccatcctcctgctaggtctagtcagacgccctctgactatagtatgatactaatgttggattgcacgtgacgagacgccgaggcacgtccaccacgtacggtcctagtattcgttagtttacgtacgtttaccgtaaccgggtccccccccgggggtacccccggggtctaggaaccgtcggttaacgaggtcgggcgtaagggtgactcgaggactatagttaattttaagaacgtaagtaaaactgaagtacgaaggtaggtaggaggtagtagggtaaggttaggggtttcggggtttaggggttaacttacgtagtcgtatagtacgtacgtaacgtccttaacctaactaacctccgttacgtacgttaccggttacgggacgggttaacgggacgaagggtcgagaacgtagacggttacgtaacgttcgtaacgg

SEQ ID NO: 328908 - DNA, 555 bp, Homo sapiens
  misc_feature: GZ8MTXP01DU457.51.76.G10.1.454.CMB.2.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggacagcagaacngcaggctccagctcncatctatgatgcataccacgaagggccactgatacncccagcctaggttcaggtgcgtaggtgggtctggggacagtacgttcacgtctacaccatcagcagcctgctagtcgtagtaagttatttgacttaattttattacttgtacagactaagtactaataacgtcggtcccttaccgttactacgttttcgggccgttacgggggtaccaacggtacgtaggaaggttacttacgtaaaccggtaagtggttacgggcttaggccaaccgttaag

SEQ ID NO: 328909 - DNA, 631 bp, Homo sapiens
  misc_feature: GZ8MTXP01DLJIV.51.76.G10.1.454.CMB.2.raw
  modified_base (298)..(298): a, c, t, g, unknown or other
  misc_feature (298)..(298): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcccgggaggtccctgagactctcctgtgcagcctctggattcacttcagtgcctatggcatgctacgtgggtccccncaggcctacgagggacgaagggggctagggaggttggggtggacttagtttanatcgaagagtgagtggactaaaagttaaataaggtcgtataggacctagttcccgtaccgggtagggaacggggtccgtaacttacccaacctacttaccctaacccgaaggaactaacctaaacttaccccaagaaaccaccgtaactgtactctagaactaaagtgaaatagtattggaagtcgcgtaagggaacgacgtaccgggttgttagttgtttacgttcgttcggtaacggaacgtaacgtctaggttagggtaagggttaaggggtaaggg

SEQ ID NO: 328910 - DNA, 541 bp, Homo sapiens
  misc_feature: GZ8MTXP01D8NKC.51.76.G10.1.454.CMB.2.raw
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccnccaggctccgaggcgaagggggctggaggtgggtgctatttagatcagatgagtggacaaagtaataagntatgcagtcncgtagaggcatcacatctacagtacgacaattcccaagaacacacgtagtatcctagacaaatagaacaagntacgganacggngaagacggacgtcgttgttagttgttacgttcgttagtaagacgtaacgtgtaggttagggtaagggttaaggggtaaggg

SEQ ID NO: 328911 - DNA, 586 bp, Homo sapiens
  misc_feature: GZ8MTXP01AT9QN.51.76.G10.1.454.CMB.2.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (378)..(378): a, c, t, g, unknown or other
  misc_feature (378)..(378): n is a, c, g, or t
  modified_base (459)..(459): a, c, t, g, unknown or other
  misc_feature (459)..(459): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagacctctcctgtgcagcctctggattccaccttcagtncctatggcatcgcacgtcgggtcccncaggcctcgaggcgaagggggctgggaggtgggtgctatttanatcgagatagagtaggactaaaagttaaataaggngtactgcctagtccgtacgtagacgggctatcacctatctacagacgaacaacttcccaagaacactactagtatcgtaanaactaaagacgaaacgagtagtaggagacgcgtaaggaacggacgtacggttcgttagttagttacgtttcgttaggtaacggtaacgtaacgtcgtaggttagggtaaggggttaaggggtaaggg

SEQ ID NO: 328912 - DNA, 629 bp, Homo sapiens
  misc_feature: GZ8MTXP01C5W74.51.76.G10.1.454.CMB.2.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattccaccttcagtgcctatggcatgcacgtgggtcccnccaggcctccgaggcgaaggggctgggaggttgggngctatttanatcagatgatggactaaaagttaaataagngtatgactagttccgtaccggtagggaacgggtccgtaattccaacctattcctaccgaagaacgtaacctaaacttaccccgaaagtaaaccacctacgttacgtaactctacggaacctaaaagtacgaaacaagtattaggaagagccgtaaggaaacggttaccgacggttcgttaggttgtttaacgttttccgaggttaacgaaaccgtaaccgtgtaaggttagggtaaggggttaaggggttaagggg

SEQ ID NO: 328913 - DNA, 607 bp, Homo sapiens
  misc_feature: GZ8MTXP01ATG8Q.51.76.G10.1.454.CMB.2.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgacgactctcctgtgcagcctntgatccacttnagtgctagngcatgctacgtcggcccgcgaggcctccgaggacggaagggggtctggggaggttggggtacgtnttaagtttatatcgagtatggagtgggactaaaaagttaaaataaggagtancggactaggttacccgtcgggtaagggaacgggtacctattaccaacctatccctaaccgaagaacgtaacaaccttacccgaaanaaccactactagtactcgtanaacaaagtacgaanaagtntaggaccgngtgaaggacgaacggtcgttgtgttcttagtttcgacgtaagacgtaacgttgaggttggtaagggttggggttaaggg

SEQ ID NO: 328914 - DNA, 611 bp, Homo sapiens
  misc_feature: GZ8MTXP01BJ5NA.51.76.G10.1.454.CMB.2.raw
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagacctctcctgtncngcctntggacttcaccttcagtgcctatggcatcggcacgtcggtcccgcaggcctcgaggcgaaggggtctgggagtgggtgctatttanatcagatgatgacaaagttaataagagtatgactagtccncggtagacgggcgtacttccgactacttcgaccgaagacgaacaacttacccgaagaaccacgtctagtactactacgaaacaaagtacgaagtaagtagttggaagtcggtcctaagggaacgaaccggtaccggttcgttcggttaagtttaaccgttttgttacggtaacgtacggtaaaccgtcgttaggttagggtaaggggtttaaggggtttaaacggggg

SEQ ID NO: 328915 - DNA, 624 bp, Homo sapiens
  misc_feature: GZ8MTXP01D70ZS.51.76.G10.1.454.CMB.2.raw
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggaggtcggtggggggagcgtggtccgaggcccgggaggtccctgagactctcctgtgcagcctctggacttccaccttcgagtcgcctagtcggcatcgctacgtcggggtccccnccgaggccctacgagggacgaagggggctaggggaggttgggtgacttatttanatacagatgatggactaaaagtaaanaagatangacaggtctcgggtaggaacgggtcctattccgaactatccgtaaccgagaacgaactaacgtcccaaagaaccacgtagtatactacctagaacctaagagaactagtattggaacgtacgcgtaaggaacggacgtaccggttgttacggttagtttaacgttccgttaggttaacgaacgtaacgtagtaggttagggtaagggtttggggtaaacgggg

SEQ ID NO: 328916 - DNA, 609 bp, Homo sapiens
  misc_feature: GZ8MTXP01A858I.51.76.G10.1.454.CMB.2.raw
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
  modified_base (580)..(580): a, c, t, g, unknown or other
  misc_feature (580)..(580): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggcccgggagtccctgacgacctctcctggtcgcagtcctcgtggacttcaccttnagtcgcctagngcatgctacgtcggcccncaggctccgaggcgaaggggctgggagtgggtgcttattanancagatgagtggactaaaagtaaataagagttacnggactacgtccgtacggtagaacgggtcctattccaactatcctacccgaagacgtaacctaaccgttaccccaaagaaccaacctacgttcgtaataccgtagaaactaaatcggaaaanggtattaggaggacnctaagggaacgacgtaacggttgttagtacgtttactttcggaggtaaccgaagtaaccgngtagttagggtaagggttggtaaaggggg

SEQ ID NO: 328917 - DNA, 552 bp, Homo sapiens
  misc_feature: GZ8MTXP01D5X1T.51.76.G10.1.454.CMB.2.raw
  modified_base (198)..(198): a, c, t, g, unknown or other
  misc_feature (198)..(198): n is a, c, g, or t
  modified_base (517)..(517): a, c, t, g, unknown or other
  misc_feature (517)..(517): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgtattagcctggaccagcagaaacctggaccaggcctcccaggctcctcatctatgatgcatccacgaaggcccatgatactcccagcctaggttcaggtggcgtaggttcggggtctgggggactagggtacgtttcaactccgtacaccactcgagccagtccctgactagtctagaagttatttcgacttaattttagtacttgtacagtactagtaattaacgtaacgtcggtacctcgttactcgttaaggccgaggggaccagcgtagacgttnttacgaaatacgtgtaggcttacgtcgccgttaag

SEQ ID NO: 328918 - DNA, 741 bp, Homo sapiens
  misc_feature: GZ8MTXP01CPVUZ.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctcatctcctgcaggtctagcagagccctctgcatagtattggatacaactattggattggcacctgcagaacgccgagggcagtctaccacgaggtcctgactcttatttggaacgtttcgtaacggtccccccgggggacccccccggggttcctggtaccgtacgggtttccaagggttcgggaccgtagggtgggactcgaacggggtccaacgtaagttaatttttaacgtaaacgttaaaggtaaaaaacttccgaaaggtaccgtaaagggtacgggttaggggaagggtcggttaggggtaaagggttaggggtttttggggtttttaaggggggtttttaactccggttaaagttttcgggaccttaaagttacgggacctaaacggtacccttaaccgttaaaccgttaaaacccttcccgtttacggttaaacggttacggttttacccgggggaacgggttaccggggttaaccgaaacggggttggaaacggtaactacggtaaacggaccgtaaacgttggtaaccggg

SEQ ID NO: 328919 - DNA, 614 bp, Homo sapiens
  misc_feature: GZ8MTXP01D617M.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcctgcaggtctagtcagacgcctctgctatagtatggatacaatattggattggcactgcagacgccgagggcagtcctaccgacgtacggtcctagtattcttatttggacgtttaccgtaacggtccccccgggggaccccccggggttcctaggaccgtaggttacaggtgggctaggtggactcgagggctaactagttaatttatacgtagaaaatcgaagacgaagaggtaggagtacgtaggtaggtaggtttgggtttaggggtttatacgtagttgctagtcgtacgtaacgtctactaactaaacctccgttacgttacgttaccggttacgggacgggttaacgggacgttaagggtaaggtagaacgtacgaagttacgtaacgttggtaacgg

SEQ ID NO: 328920 - DNA, 554 bp, Homo sapiens
  misc_feature: GZ8MTXP01DZXHN.51.76.G10.1.454.CMB.2.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctntgacttcacttnagtcgcctatggcatgcacgtcggtcccgcaggcctccgaggcgaaggggctgggagtgggtgctatttanatcagatgagtgataaagtaataagatangacagtcgtcgngacgcatcactntcacganacacactccaagacacacgtagtactcagactaaagtagaacagtatagagtacgacgtaaggaacgacgtacggttgttagttagtttacgtttcgttagttaaccggaacgtaacggtcttaagggttggtaacggggttaaggggttaagggg

SEQ ID NO: 328921 - DNA, 540 bp, Homo sapiens
  misc_feature: GZ8MTXP01EYHAD.51.76.G10.1.454.CMB.2.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagcgatcgtatacacgaccggtgctcgatttagtcactcatacagggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagctctcctgtgcagcctntggattcaccttnagtgcctatggcatgcacgtggggtcccnccagggcctccgaggcgaagggggctgggaggtgggtgctatttanatcagatgatgggacaagtaaanaaagngtatgcagtctcgtagagggcattcacatctcaganacaacttcccaagaacactactgtactctagaccaaatagaaactagtagtgagaagcgttaggacggacgacggtcttaggttnttacgtttcgnggtaacgacgaaacgttcttaaggttggtaagggg

SEQ ID NO: 328922 - DNA, 593 bp, Homo sapiens
  misc_feature: GZ8MTXP01AP3Y5.51.76.G10.1.454.CMB.2.raw
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgccccgtcacccctggagacgccggcctccatcctcctgcaggtctagtcagacgccctccngcatagtattggatacaactnttggattggacctgcagaagccgagggcagtcctccacgaggtcctgattctatttgacgttactaacggtcccggggcccccccccgggttctaggacgtacggttcaagtggcaggtggatcgaggacatagtatttanactagaaactcagacaggtagtaggaggngtaggaggtagttgggggttaggggtttatcgtagttgcagtgactagtctactaactaaacttcctacgttacggtaccggtttcgggacgggtaacgggttaacccgttaggggttacggaacgtacgtaacgaacggtacggttaacgtggttaacggtcccg

SEQ ID NO: 328923 - DNA, 539 bp, Homo sapiens
  misc_feature: GZ8MTXP01BJCSU.51.76.G10.1.454.CMB.2.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngcccacctctcctgcagggccagtcagagtgtagcagcgacttagcctggaccagcagaacctggccaggcctcccgaggcctcctnatctatgatgcatccagaacggccagtgatacncccagcctaggttcaggtcgcgtaggtcgggtctggggactagggtacgttacactctcaactatcgagcagccgtgactagtctagtaagttatttgtacttaatttattacgtgtacagtactaagtaactaagtacgtcgtacccttcgtactgtttcggaccgaggggaccaggtcgtagagattacgaacgtagtgtcgcttacgtcgaacgtcg

SEQ ID NO: 328924 - DNA, 592 bp, Homo sapiens
  misc_feature: GZ8MTXP01EXEMS.51.76.G10.1.454.CMB.2.raw
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggacttccaccttcagtcgcctatggcatgcacgtgggtcccncaggcctcgaggcgaaggggctgggaggtgggtgctatttanatcagtatgatggactaaaagtaataagntatgactagtcgtcgtagacggcgtattacacctatcctacgaagtacgaacctaacttaccccaagtaaaccacgtactagttactaccgtagaaactaaagtacgaaacgtaagtagttaaggagacgcgtaaggaacggacgacgggttgttagtacgtttagtttcgaggtaacgacgtaaagtcgtagttagggtaagggttaaggggtaagggg

SEQ ID NO: 328925 - DNA, 543 bp, Homo sapiens
  misc_feature: GZ8MTXP01BBBP9.51.76.G10.1.454.CMB.2.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctcatctcctgcaggtctagtcagagcctctgcatagtattggatacaactattggattggcacctgcagaagccagggcagtctcacaggtcctgatctattgagttctacgtccccgggccccggtctgacnggttcagtgcagtggatgaggcanagtatttanactagaaatcagcagagtggagngtagaggtagttggtttaggggtttancgtagttcgatagtggactaagtcctactaaactaaaccttccttacgtacgttaccgtttacgggacgggttaacgggaccgttaagggtcggaagaacgtaacgaaggttacccgtaagttggtcgg

SEQ ID NO: 328926 - DNA, 577 bp, Homo sapiens
  misc_feature: GZ8MTXP01D91VZ.51.76.G10.1.454.CMB.2.raw
  modified_base (292)..(292): a, c, t, g, unknown or other
  misc_feature (292)..(292): n is a, c, g, or t
  modified_base (390)..(390): a, c, t, g, unknown or other
  misc_feature (390)..(390): n is a, c, g, or t
  modified_base (408)..(408): a, c, t, g, unknown or other
  misc_feature (408)..(408): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctcgcccgtccaccccgtggacgacgccggcctcatctcctgcaggtctagtcagacgcctcctgcatagtatggatacaactattggattggcactgcagagccagggcagtctccagnggtctgatcttatttgagttcaacgtcccccggggcccccgggtctgacaggttcaggtgggctagggtggactcgacggctaacgtagttattttanaactagtaaaatcgaagngagaggtggagataggaggtaggtttgggtttaggggtttaatcgtaagttgacgtattagacgtaaacgtcttaacaacctaaacttccttacgttaacgttacgttacggggaacggaacggggttacgttaaggtgggataagtacgacgaccggtaagttggtcg

SEQ ID NO: 328927 - DNA, 552 bp, Homo sapiens
  misc_feature: GZ8MTXP01AKBP0.51.76.G10.1.454.CMB.2.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcaagaaacctggccaggcctccgaggcctcctnatctatgatgcatccaacgaagggccactgactactcccagccgtaggttcaggtggacaggtcgggtctggggactaggtacgtttcactctcaccatcagcacgcctgacagtctagaagttatttgacttaatttacttactgtactagactagtaataataacgtcgtcctaccgtactcgtttcgggaccgttaggggaccaaggcgttagggacgttacttacgaaaacgtacgtgtcggcttcgaacaaccgttaag

SEQ ID NO: 328928 - DNA, 529 bp, Homo sapiens
  misc_feature: GZ8MTXP01CQUCR.51.76.G10.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagctctcctgtgcagcctntggattcacttcagtgcctatggcatgccacgtgggcccnccaggcctccgagggcgaagggggctgggagtgggtgctatttanactcagatgagtggacaagtaaataaagnttangcagtctcgagacggcatcacatcacaganacactaccagaacactactgactctagactaaatagaactagtattaggagaagcgttaggaaggccgaggtcgttagttgttactttcgaggttcggaacgtacgacgttaagttggtaagggg

SEQ ID NO: 328929 - DNA, 598 bp, Homo sapiens
  misc_feature: GZ8MTXP01E0SY4.51.76.G10.1.454.CMB.2.raw
  modified_base (337)..(337): a, c, t, g, unknown or other
  misc_feature (337)..(337): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagctctcctgtgcagcctctggattcacttcagtgcctatggcatggcacgtgggtcccgccaggctccgaggcgaaggggctgggaggtgggtggctatttanatcagatgatggactaaaagtaaataagagtaatgacgagttcgtaccggtaggaacggggccagttcaaccaattccgtacccgaaggacactaaacttaccccaagaaaccaactacttacgtactccttagacaaaagtacgaaacgaagtattagagacgngtaaggaacggacgacgggttctaggttacgttatttccgttagttaacgggaacctaacgggtctaaggttggtaagggttggggttaaaggggg

SEQ ID NO: 328930 - DNA, 523 bp, Homo sapiens
  misc_feature: GZ8MTXP01AMQDM.51.76.G10.1.454.CMB.2.raw
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcactgggtcccnccaggcctcaggcaagggggctggagtgggtgctatttanatcagatgatggacaaaggtaataagngtactggacagtctccggtagaacgggccgattcaccatctaccagagacaacttcccaagacacacgtgtatctagacaatgaacagtatgagagctaagaggacacgggttgtgtgttcgttcgttgtaagacgaacgtgtagttggtaaggttgggtaagg

SEQ ID NO: 328931 - DNA, 800 bp, Homo sapiens
  misc_feature: GZ8MTXP01D7AE9.51.76.G10.1.454.CMB.2.raw
  modified_base (396)..(396): a, c, t, g, unknown or other
  misc_feature (396)..(396): n is a, c, g, or t
  modified_base (726)..(726): a, c, t, g, unknown or other
  misc_feature (726)..(726): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggcccgggagtccctgacgtactctctgtgcacgtcctgtggtacttcaccttcagtcgcctagcggcagtcgctacgtcggggtccccgaccgaggtccctacccggaagggtaccggaaaggggggtccttagggggtacgggttgggggtacgtaccttaagtttttaanaccgtacgaaggtagttggaagttaacgggaactaaggttaaaaagtaaaacgggaggttaagtacgggaccgttaaagggtttccccgtacccgggttaggggtaaaccgggggtccccttaaagttaccccaaacccggttaacttaccccgttaaaccgtaaacgggaaaccgtaaccttaaaccccgttacccccgaaagttaaaccccaacgttaaacggttcgttaaactccgttaaacggaaacctttaaaacgtaagggaaacctaaaggttaacgttaggaggaaacggtcgttagggaaaccggttaccgtaaccgggtntttaggtttgttaaccgttttgagggttccggtaaaacggtaaccgttacgttaaggttaaggggttaaggggg

SEQ ID NO: 328932 - DNA, 737 bp, Homo sapiens
  misc_feature: GZ8MTXP01ES37Y.51.76.G10.1.454.CMB.2.raw
  modified_base (257)..(257): a, c, t, g, unknown or other
  misc_feature (257)..(257): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctntggtattcaccttcagtcgcctagtggcatcgcacgtcgggtcccgccgaggcctccgagggcggaagggggccgtggggaggtgggggtggtacttaagttttataacgtcgaagtagtggacgtagggaactaaggttaaaagtaaaagggtagttaagtacggtacgtaggttacccgttacccgggttaagggaaaccggggtacccgtaactttaaccccgaacccgttaaacgttcccttaacccgaaagggtaaaccgtaaaccctaaaccctttaaccccgaaaaggaaaccctaactaacggtttacgttaacttacgtacgaaacctaaaagtaccgaaagtaagtaagttaggaaggtaagtacgttagggaacggttaccgtaaccgggtgtttaggtttgtttaccgtttcggttaggttaaccggaaaccggtaaccggttagttaaggttaagggttaagggggg

SEQ ID NO: 328933 - DNA, 604 bp, Homo sapiens
  misc_feature: GZ8MTXP01D34P8.51.76.G10.1.454.CMB.2.raw
  modified_base (154)..(154): a, c, t, g, unknown or other
  misc_feature (154)..(154): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(279): a, c, t, g, unknown or other
  misc_feature (278)..(279): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggttttccncgttgctcttttaagaggtgtccagtgtcaggtgcagctggtggagtcgtgggggagcgtggtccaggcccgggagtccctgagctctcctgtncagcctntggattcacttcagtcnctngcnngcncgtcggccncgagcncgaggcgaggcgtggaggtggtgatatttatactcgaagtatgagtaacgataagtaaagtaaagagtacgtcgacgtacgtccgtacggtaggaacggtcctaactaccaaccgtacgtccaacgaacgaacaacctaactaccaacgaaacacgtacgttatactacgacgaactaacgtaacgaacgtaagtaagtagtaagtaacgtacgttaggtacggacggtacgtacgttaggttcgtttacgtttaacgttacggtaacggtaacgtaacgttacggttaacggttaagggtaagggg

SEQ ID NO: 328934 - DNA, 697 bp, Homo sapiens
  misc_feature: GZ8MTXP01BGDIT.51.76.G10.1.454.CMB.2.raw
  modified_base (374)..(374): a, c, t, g, unknown or other
  misc_feature (374)..(374): n is a, c, g, or t
  modified_base (601)..(601): a, c, t, g, unknown or other
  misc_feature (601)..(601): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccaggcccgggagtccctgacgctctcctgtgcagtcctctggattccaccttcagtcgacctagtcggctatcgccacggttcgggtcccaccgagggccctaccggaagggcgaaagggggtctgggggaggtgggggtcgtacttaattttanatacgaaggtacttaggagttcgggaacgtaaaaaggttaaaaagtaaggtacgttaagtaggaccgttaacgggttccccgtaccgggttaggggaaaccgggtcccttaacgttacccaaccgtaacttccgtaacccgaaggtaactaacctaaaccttaccccgaaagtaaacctaccgtacgttacgtaccttacgaacgtaacaaagtagaaactaaggtntaaggagacgcgtaagggacgttacgtacggttgttaggttcttacgttgacgtaacgtacgaacgttgaggttaggtaaggggttaagggtaagg

SEQ ID NO: 328935 - DNA, 565 bp, Homo sapiens
  misc_feature: GZ8MTXP01BUPTV.51.76.G10.1.454.CMB.2.raw
  modified_base (377)..(377): a, c, t, g, unknown or other
  misc_feature (377)..(377): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtggtttcgcgttagctctttaagaggtgtccagtgtcaggtgcagctggtggagtcgtgggggagcgtggtccaggcccgggaggtccctgagactctcctgtgcagcctctgattccaccttcagtcgcctagtggcagtgccacgtcgggtcccgcagggcctccgaggcgtaagggggctgggagtgggtgctatttagatcagatgatggactaaagtaaataagagttancgactacgtcgtacggaggacggtcctactaccactatccacgagacaactaactaccaagaacacgtacgtagtactcacgaanaataagaagaagtagtagagagngaaggacggacgtacggttcgtgttgttagttcgttagtaagacgtaacgtacgtagttaggtaaggttaagggtaaggg

SEQ ID NO: 328936 - DNA, 587 bp, Homo sapiens
  misc_feature: GZ8MTXP01EC8JE.51.76.G10.1.454.CMB.2.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (524)..(524): a, c, t, g, unknown or other
  misc_feature (524)..(524): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctgggtggagtcgtgggggagcgtggtccgaggcccgggtagtccctgacgactctctgtncagcctctgattcacttcagtgcctatgcatgcacgtcgggtcccnccgaggcctcgaggcgaagggggtctggaggttgggtgcttagtttanatcagatgagtgactaaaagtaaataaggtatagtgacgtagtccgtacgggtaggacgggctagttacactactccgtacagacgactaactaccgaanaacactacggtntatcctagaacaaatgtaaacaagtatacgagacgcgtaaggacgaaccgacggttgttaggttnttaacgtttcgttaggtcggaacgtaaacgtgtagttagggtaagggttggggttaaaggggg

SEQ ID NO: 328937 - DNA, 568 bp, Homo sapiens
  misc_feature: GZ8MTXP01DK41F.51.76.G10.1.454.CMB.2.raw
  modified_base (364)..(364): a, c, t, g, unknown or other
  misc_feature (364)..(364): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctcatctctgcaggtctagtcagacgcctctgcatagtatggatacatattggattggcactgacagagccagggcagtctacagacggtcctgatctatttgacgttctaacgtccccggggccccggtctgactgtcagtgcagtgatcgagcacagtatttanactagaaatcgagtcagacgtggagtcgtagaggtaggttggtttggggtttaatcgtagttcggctagtcgactaacgtctacctaacctaaacttccgttagttacggaccgttttacgggggacgggttaaacggggttaccaaaggggttggaaacgtaacgttaaccggaaggttacccggtaacgttgggtaaccggg

SEQ ID NO: 328938 - DNA, 636 bp, Homo sapiens
  misc_feature: GZ8MTXP01DD89G.51.76.G10.1.454.CMB.2.raw
  modified_base (298)..(298): a, c, t, g, unknown or other
  misc_feature (298)..(298): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagactctcctgtgcagcctctggattcaccttcagtgcctatggcatgcacgtgggtcccnccaggcctccgaggcgaagggggctgggaggtgggtgctagtttatatcgagtatgagtaggactaagtaaataaagagtaagtgactagtccgtaccgtaggaacgggtccgtattaccaccctaactcctaccaagtacgaacctaaacttaccccgaaagtaaaccaacctaaccgttagttaactccgtagaacctaaaattaagaaactaaggtaattaggaaggtaacgtcgagggaacgggaccgtaacgggtccgttaggtttgtttaacgtttccgttaggtaacggtaaccggtaaaccgacgttttttaaggaagggtttaaggggg

SEQ ID NO: 328939 - DNA, 577 bp, Homo sapiens
  misc_feature: GZ8MTXP01BT3MD.51.76.G10.1.454.CMB.2.raw
  modified_base (188)..(188): a, c, t, g, unknown or other
  misc_feature (188)..(188): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggcccgggagtccctgagacctctctgtgcagcctntgattcaccttnagtgcctangcatgcacgtgggccncaggctccgaggcgaaggggctgggagtgggtgactatttanatcagatgatggactaaaagtaaataagntagtgactagtcgtacgtaggacgggctattaccacctatcctaccgaagacgaaccaacttaccccaagaaacctacacgttagtactacctagaacctaaagtagaaactaagagttagagtacgcgtaaggaacggttacgacgggttgtagttattagttcgaggtaacgacgtaacgtgtaggttagggtaagggttaaggggtaagg

SEQ ID NO: 328940 - DNA, 579 bp, Homo sapiens
  misc_feature: GZ8MTXP01AZHK4.51.76.G10.1.454.CMB.2.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgtagcagcgacttagcctggtaccagcagaacctggccaggctccagctccnatcatgatgcatccagaacggccatgatactcccagcctaggttcaggtggcaggtcgggtctggggacagtacgttcactctacaccatcagcacgtcctgacctagttctagtaagttntttagactttaaatttagttactgttacagtacaagtaacttaacgttaacgtcgtacccgttaccgttaacgttaccggtttcggacccggttaacgggggtaacccttaagggtccgttaaggacggttacttaacgtaaacggtacgtggttcggacgttcgaacgttaacctcg

SEQ ID NO: 328941 - DNA, 576 bp, Homo sapiens
  misc_feature: GZ8MTXP01CJHKS.51.76.G10.1.454.CMB.2.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (391)..(391): a, c, t, g, unknown or other
  misc_feature (391)..(391): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccgggaggtccctgagactctcctgtgcagcctctggattccaccttcagtgcctatggcatgcacgtgggtcccgccaggcctccgagggcaagggggctgggagtggggnggctatttanatcagatgatggactaaaagttaaataagagtatggcagtctacgnggaacgggccgattcactatctaccagacgacaacttccccaaagaaccaacgtactagttactctacgaacaaatacgaaacaagtagttagaagacgcgtaaggaacggactacggcgttaggttgtttagtttcgttaggtcgacggaaacgtcgtagttggtaagggttggggttaagggg

SEQ ID NO: 328942 - DNA, 575 bp, Homo sapiens
  misc_feature: GZ8MTXP01CBFXD.51.76.G10.1.454.CMB.2.raw
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (432)..(432): a, c, t, g, unknown or other
  misc_feature (432)..(432): n is a, c, g, or t
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcccgggagtccctgagactctcctgtgcagcctctggattccaccttcagtgcctatggcatgcacgtgggtcccncgaggcctccgagggcgaagggggctaggggaggtgggggtcgcttaatttanatcagtatggatggactaaagtaaataagngtatgacagtcncggtagaacgggctatcacatctacagacacaactccaanaacacactagtactactagaacaaatgaaactagattggaagacgngtaagggaacgacgtaccgggttnttggtagtttacgtttcgagttaacggaacgtaaacgtgtaagttagggtaacgggttaagggggttaagggg

SEQ ID NO: 328943 - DNA, 539 bp, Homo sapiens
  misc_feature: GZ8MTXP01BO8XP.51.76.G10.1.454.CMB.2.raw
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggccnccaggcctccgaggcgaagggggctgggacggtgggtgactatttagatcagtatgatggactaaaaggtaaataaggngtangactagtcgacgagacgctatcactatcgacagacactaactaccaanaacactagtatatcagaacaanagaanagagtagagagngaagagacgacgttcgtgttgttagttcgttagtaagtacgtaacgtacgtagttaggtaagggttaagggtaaggg

SEQ ID NO: 328944 - DNA, 622 bp, Homo sapiens
  misc_feature: GZ8MTXP01D5XQD.51.76.G10.1.454.CMB.2.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgtacctctcctgtgcagcctctgacttccaccttcagtcgcctagtcggcatgccacgtcgggtcccnccaggcctcgaggcgaaggggctggagtgggtgctatttantcagntgagtggactaaaagtaaataagngtatcgctagtcgtaccggtagaacgggcctaattccaccgtatacccgtaaccgaggtaacaacctaactaccccaagaaactacctaacgttagtactctacgaataaacgtgaactaagtattagaagtaagcgtaagggaacggttacgacggttcgttaggttatttacgtttcgttagggtaaccgtaaacggtaaacgttcgtagggttagggtaaggggttcgggggtttaaaggggg

SEQ ID NO: 328945 - DNA, 570 bp, Homo sapiens
  misc_feature: GZ8MTXP01DUDX5.51.76.G10.1.454.CMB.2.raw
  modified_base (71)..(71): a, c, t, g, unknown or other
  misc_feature (71)..(71): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacagggggggagaggagcccagcactanaagtcggcggtgtttccattcggtgatcagcactgaacacagaggactcaccatggagtttgggctgagcgttgggttttcctcgttgctcttttaagaggtgtccagtgtcaggtgcagctgggtggagtcgtggggggagcgtggtccaggcccgggagtccctgacgactctcctgtgcagcctctggattcacttnagtgcctagngcatgcacgtggccncaggcctccgaggacgaagggggctgggagtgggtgactatttanatcgaagatgaagtggaactaaaagtaaataaggactntgctaggtccgtcgtaggacggcctatacacatcacgagtacacaacgtcccaagaacacacgtntatcacgaanaaatacgaanaagtattagagagcgaagaacgggactacgggttcgttagttcgttacgttgttacggtaacgaacgtaaccgtggtagttaggggtaagggttaaggggtaaggg

SEQ ID NO: 328946 - DNA, 756 bp, Homo sapiens
  misc_feature: GZ8MTXP01D256C.51.76.G10.1.454.CMB.2.raw
  modified_base (215)..(215): a, c, t, g, unknown or other
  misc_feature (215)..(215): n is a, c, g, or t
tcagcgatcgtatacacgaccggtgctcgatttagtcactcatacagggggtgatcaggactcctcagttcaccttctcacaatgaggctccctgctcagcctcctggggctgctaatgctctgggtctctggatccagtggggatattgtgatgactcagtctccactcctccctgccccgtcaccccgtggagacgcccggcctccatctccngcaggtctagtcagacgtccctcgtgctaatagtattggataacaactagttggattcggcaccgtgacaagacgccgagggcagtcctaccagtcggtcctgtacttcgttatttcggagtttaccgtaaccggtccccccgggggcccccccggggttctggtaaccgtacgggtttaccaagggtggggtactagggtacggtactaccggacgggtactaacgttaagttaattttaacgtaacgtaaaggtaaaacttaccgaagggtaccgaaagggtagggtacgggtaagggtcgttaagggtaaggggttaggggttttaggggttttagggggtttaacttaccgtaggttaccgtacgtaagttcgggtaacctaaccgttaacccgttaccttaaaccgtaaaacccctttccgttaaccgggtttaaacggttaccgggttttaccgggggaccggggttaaaccggggttaccggaaagggttaaggaaccgtaagtaccgaaggttaccgtaacgttggtaaccgg

SEQ ID NO: 328947 - DNA, 557 bp, Homo sapiens
  misc_feature: GZ8MTXP01C900A.51.76.G10.1.454.CMB.2.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggcgaggcgtggtccaggcccgggaggtccctgagactctcctgtgcagcctntggattcacttcagtgcctatggcatgcacgtgggtcccncagcctacgaggcgaagggggctgggagtgggtgctattagtatccagatgagtgaactaagtaanaaagagtatgacaggtctacgtagacgggctatacacctatcctaccagtacgaactaactaccaagtaaccaactactagtatactagaacaaagtacgaaanagtattagaagngcgtaggacgacgacggtgttagttgttacgtttctggtagtaaccgaaagcgttagtggttaagggttaaggggg

SEQ ID NO: 328948 - DNA, 717 bp, Homo sapiens
  misc_feature: GZ8MTXP01EZZZM.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactcctccctcgcccgtcaacccgtggagacgccgcctccatctcctgcaggtctagtcagacgtccctctgactatagtatgatactaatagttggattgctacgtgcgaagaacgcgagggctagtccctaccaacgacggttcctagtacttctagtttgaacgtttccgtaaacggtcccccccgggggtacccccccgggtctaggtaaccgtagggtttacccgaaggttcggggacctaaggggttacgggtaactacgggtaacggggaccctaaacggttaaaggtttaaatttttaaaccgtaaacgttaaaaaagtaaaacgtacggaaacgtacggtaaagggtacgggtagggaggtacggttaagggtaagggtttagggtttacggggtttaagggttacttagtagttgagtaagtacgaacgtaacgtacctaaccgtaactaactccgttacgtaacgttaccgggtacgggaacgggttaacggttacggttaagggtaagaagtaacgtaacgacggacgtaacgttggtaacg

SEQ ID NO: 328949 - DNA, 615 bp, Homo sapiens
  misc_feature: GZ8MTXP01AZNIY.51.76.G10.1.454.CMB.2.raw
  modified_base (456)..(456): a, c, t, g, unknown or other
  misc_feature (456)..(456): n is a, c, g, or t
  modified_base (563)..(563): a, c, t, g, unknown or other
  misc_feature (563)..(563): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgacgactctcctgtgcagccctcgtggacttcaccttcagtgcctagtggcatgcacgtgggtccgccaggcctccgaggccgaaaggggggctggggaggtgggtcggtactagtttatacgtcaggtatgaagtgggacaagttaaataaaggaggtatggacaagtcctccggtagggaaacgggccgtaattccgaacgtactccgtacaacggtanaacctaaacgttacccaaagaaccgaactaacgttgtaacttactacgacctaaaagtagaaacgagtagttaggagaacgacgttggacggttacgaaccgggttnttaggttacgtttacgttcgtgtaacgacgaaacgttgtaagttggtaaggg

SEQ ID NO: 328950 - DNA, 638 bp, Homo sapiens
  misc_feature: GZ8MTXP01CK5J1.51.76.G10.1.454.CMB.2.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
  modified_base (597)..(597): a, c, t, g, unknown or other
  misc_feature (597)..(597): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcccgggagtccctgagactctcctgtncagcctctggacttcaccttcagtcgcctagtggcagtgccacgtcggggtcccgccagggcctccgaggccggaagggggctgggaggtgggtcgtctatttanactcgagtagtgagtagggactaaggtaaataaaaggagttagtcgactagttcccgtacccggtaagggaaccgggtccctagttaccgaaccacttaccgtaccaagaacgtaactaaccgttacccgaaagaaaccacgttaacttgtacttacgtacgaactaaagtcgaaactagtaagttaggaacgaagtaccgaggaacggaccgaacggtgttaggttcttacgtttcggngtaacgggaacctaacggttcgtaagttaaggttaaggggg

SEQ ID NO: 328951 - DNA, 555 bp, Homo sapiens
  misc_feature: GZ8MTXP01ET8EI.51.76.G10.1.454.CMB.2.raw
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctctgcatagtattggatacaactattggattgcacctgcagagccagggcagtcncanaggtctgatctatttgagttcacgtccccgggccccggtctgactaggtcagtgcagtgatcgaggcatagtatttatactagaaatcaagtcagagtcggagngtagaggtagttgggtttaggggttatgtaagttggactagttacggctaacgtacttacctaaacctaaacctttccgttacgttacggttacgtttccggggacggggttaacggttaccggaaagggtcgagtaacgtcgaacggcggtaacgttgggtcgg

SEQ ID NO: 328952 - DNA, 744 bp, Homo sapiens
  misc_feature: GZ8MTXP01C44RS.51.76.G10.1.454.CMB.2.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcggtggccaggcccgggagtcccngagactctcctgtcgcacgcctctaggacttccaccttnagtcgcctatggcatcgcctacgtgggtcccgccgagggcctccggaggcggaaagggggctggggaggttggggtgtacttatttanatcgaagagttaggagtacggaactaaaaggttaaaataaagggtagtaagtacggtacgtaacggttcccgtaccgggtaacgggtaaacggggtccctaacgttaccaacccttattaccccgtaaccgaaagggtaacctaaaccgtaaaccttaccccaaaggaaacctaaccgtaacgttacgttaactacgtacgaaactaaaagtacgaaacgtaagttagttaaggaacgtacggtacggttaacgggaacggttacccggtaaccggttcgttacggtttagtttaaacgtttccgttaggggttaaccggaaaccggttaaacggtcgttaagggttaggggttaaggggttaagggggtttaaacggggg

SEQ ID NO: 328953 - DNA, 611 bp, Homo sapiens
  misc_feature: GZ8MTXP01ESG39.51.76.G10.1.454.CMB.2.raw
  modified_base (391)..(391): a, c, t, g, unknown or other
  misc_feature (391)..(391): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgccccgtcacccctggagacgcccggcctccatctcctgcaggtctagtcagacgccctctgcatagtattggatacaatattggattggcacctgcagagccgagggcagtcctccagaggtcctgattcttatttgagttcctaacgtcccccggggcccccgggtctgactggttccaggtggcaggtgatcgaggcaacgtagttattttaanactaagaaactgtaagcgtaaggagggtggaggtcgtaggaagggttaggtttggggttttaggggtttaatcgtaagtttggactagttacgactaaacggtccttaacctaacctaaacttcccgttacgttaacggttaccgtttaccgggggacgggttaacgggacgttaaggggtcggagtaacgtaacggagttacggtaacgttggtaacgg

SEQ ID NO: 328954 - DNA, 618 bp, Homo sapiens
  misc_feature: GZ8MTXP01AW9M9.51.76.G10.1.454.CMB.2.raw
  modified_base (275)..(275): a, c, t, g, unknown or other
  misc_feature (275)..(275): n is a, c, g, or t
  modified_base (348)..(348): a, c, t, g, unknown or other
  misc_feature (348)..(348): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggccccggggaggtccctgacgacctctcctgtgcagcctctggattcaccttnagtgcctatggcatgcacgtgggtcccgccaggcctccgagggcgaagggggctgggagtgggtgctatttanatcagatgatggactaaagtaaataagagtangctagtcgtccggtaggaacgggccctattccgacctaagttcctaccgaagacgtaaccaaaccttcccgaaagaaaccctaccgtaacttgtaacctcttaggaaacctaaaagtacgaaacagtaagttagaagacgtcgtaaggaacggttaccgacggcgtttaggtatttaggtttccttagggctaacgggtaaacctgtagttagggtaagggttaagggggttaagggg

SEQ ID NO: 328955 - DNA, 737 bp, Homo sapiens
  misc_feature: GZ8MTXP01EE222.51.76.G10.1.454.CMB.2.raw
  modified_base (151)..(151): a, c, t, g, unknown or other
  misc_feature (151)..(151): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcgtggtttccncgttagctctttaagaggtgtccagtgtcaggtgcagctggtggagtcgtggggggagcgtggtccaggcccgggagtccctgagtactcncctgtgcagcctctgactcacctcagtcgcctatggcagtcgcacggtcgggtccccgacgaggtccnccggaggccgaagggggtcgtgggagggttgggtggacttatttaanatagagtagtagagtacggaacgtaaaagttaaaagtaagtaggtacgtcgtacgtacgttcccggtacggtaacgggtaaccgggtacctactacccactacctacccgtaaccgaacgaacgtaaacctaacccgttaacccgaaacgtaaccctaaccgttaacggttacgttaaaccttacgtaaacgaaacgtaaacgtaaacgtaaacgtaaacgtaagtaaggaacggtaacggtaacggtaacgggtaaacgggaaccgggtaccggttaacggttacggtttaacggttacgtttacgttacggttaaccggtaacggtaaaccgtaacggtaagggttaggggttaagggggttaagggggttaaggggg

SEQ ID NO: 328956 - DNA, 647 bp, Homo sapiens
  misc_feature: GZ8MTXP01ALY8I.51.76.G10.1.454.CMB.2.raw
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (590)..(590): a, c, t, g, unknown or other
  misc_feature (590)..(590): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccaggcccgggagtccctgacgactctccgtgtgcacgcctgtggattccaccttnagtcgcctagtggcagtcgccacgtcgggtcccnccgaggcctccgaggccgaagggggctagggacggtgggtgacttatttanactcgagtatgagtggactaagttaaanaaaggattagngtacgtagtccgtacggtagaacgggtccgtacttaccgaactacgtacctaacgacgaaacgtaacctaaaccttacccgaaagaaacctaacgttaacgttacgttaactaccgtaggtaaccaaaagttaccgaaacgtagtaagttacggagtaacgacggttaggaaaccggacgtaccgggttnttacggttgttacgttgtgtaacggaacgtacgttacgtaaggttaacgggtaaggg

SEQ ID NO: 328957 - DNA, 584 bp, Homo sapiens
  misc_feature: GZ8MTXP01A5W7X.51.76.G10.1.454.CMB.2.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (547)..(547): a, c, t, g, unknown or other
  misc_feature (547)..(547): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagtcttgggttttcctcgttgcttcttttaagaggttgtccagtgtcaggtgcagcgtggtggagtcggtgggggagcgtggtccaggcccgggagtccctgacgctctctgtncagcctgtggattcaccttnagtcgcctatggcatcgcacgtgggtcccgcaggcctccgaggcgaaggggctggnggtgggtcgctatttnactnagntgatacgggataaggtaaataaacggngtaatggactacgttcgtccggtagaacggcgttatcaccatacctacgaagtaacgactaaaccttaccgaataaccataccttagtactctagacctaaagtaccgaatgtattaggagtaagcgttaggaacgacgtacggttcttaggttgttaccgttttgngtaacggacgtaaacgcttaaggttcgggtaaggggg

SEQ ID NO: 328958 - DNA, 745 bp, Homo sapiens
  misc_feature: GZ8MTXP01EXQLS.51.76.G10.1.454.CMB.2.raw
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (538)..(538): a, c, t, g, unknown or other
  misc_feature (538)..(538): n is a, c, g, or t
tcagcgatcgtatacacgaccggtgctcgatttagtcactcatacagggggggagaggagcccagcactagaagtcggcggtgtttccattcggtgatcagcactgaacacagaggacttaccatggagtttgggctgagcttgggttttcctcgttgctcttttaagaggtgtccagtgtcaggtgcagctggtggagtcgtgggggagcgtggtccaggcccgggagtccctgagctctcctgtgcagcctctggtacttcacccttcagtcgcctagtggcatcgctacgtcgggtccnccgaggcctccgaggcgaagggggctgggaggtgggtgactagtttanatcgagtagtcggagtagggactaaaggttaaaaaaagtaaagggtgtttaagtacggtacgtaacggtttcccgttaccccgggggtaaggggaaacgggggtaccccttaagtttaccccaacccggtaacttcccgaacccgtaaacgggaaccttaaacccgtaaaaccctttccccggaaaanaaacccttaaccgtactttaggggttaactacgttagaacctaaaagttaccggaaactaaggtaattagggaaacggacgttaccggaagggaaacgggtaaccgttaaccggggtttcgtttagggttacttttacgttcggttggttaaccgtaacgtaacgtgtagggtagggttagggttaagggggttaagggttaagggg

SEQ ID NO: 328959 - DNA, 568 bp, Homo sapiens
  misc_feature: GZ8MTXP01D479N.51.76.G10.1.454.CMB.2.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcccgggaggtccctgacgactctcctgtgcagcctctggacttcaccttcagtgcctagtggcagtcgcacgtggggtccccnccgagggcctaccgagggcgaaagggggctgggagggtgggtggcttaagtttanagtcagtatgagtggactaaagtaaataaggntatcgactagtctcgtagacgggctatcactatctacgagacgacacgtcccaagaacactactgtactctagaacaaatcgaaanagtataggagtagcgtaaggacggacgacgggttgttggttgttacgttcgttgtaagacgaacgtgtagttgggtaagggttgggtaagg

SEQ ID NO: 328960 - DNA, 671 bp, Homo sapiens
  misc_feature: GZ8MTXP01A08TF.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtctccactcctccctcgccccgtcaccccgtggagacgccggcctccatcctcctgcaggtctagtcagacgcctctgactatagtatggatacaatattggattggcacgtgacagaacgcgagggcacgtctacacgaggtcctgtacttcttagtttcgacgttaccgtaaccggtccccccggggtccccccggggttctacggtaccgtacgggttaaccgaagggttcgggacgtaacgggttcggaacgttacggacggggtacctaaacgtaaacgtttaatttttaaacgtaaccgtaaaggtaaaacttcgaaaggacgaagggtaacgggtagggacggtacgtagggtaaggggttaggtttaggggtttaggggtttactacgtagttcggactagtacgactaagtcctaactaactaaacgttccttagttacgttacggttcgggacggttacgggaccgttagggtggagtaacgtacgagacgtcgttggtcg

SEQ ID NO: 328961 - DNA, 602 bp, Homo sapiens
  misc_feature: GZ8MTXP01CCLOP.51.76.G10.1.454.CMB.2.raw
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctctgtgcagcctctggattcaccttcagtcgcctagtggcatgcacgtgggtcccgccgaggcctccgagggacgaagggggcgtgggagtggggtgctatttanatcagatgagtgacaaagtaaataagcgtangacagtcgtccgtaggacgggctattcactatctaccaagacgtaacaaccttcccaaagtaaccactaacgtagtatactanaacgtaaanagaacgagtagtagagtagcgtaaggacgaccgtacggttcgtaggtttacgttacgtttcgttacgttaacggaaaccggtaaaccgttcgttaaggttacggggttaaggggttgggggtttaaaggggg

SEQ ID NO: 328962 - DNA, 544 bp, Homo sapiens
  misc_feature: GZ8MTXP01DZ2EJ.51.76.G10.1.454.CMB.2.raw
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcacttcagtncctatggcatgcacgtgggtcccnccaggcctaccgaggcaagggggctggagtggggtgctatttanancagatganganaaaagtaaataagngtatcgactagtctacgaggacggctatcacatacacgagacaactaactaccaanaactacacgtntactnaganaanaagaanaagtagtagagagngaagagacgacgttcgtgttgttagttcgttaggtaacgtaacgaacgtagtagttaggtaagggttaaggggtaagggg

SEQ ID NO: 328963 - DNA, 656 bp, Homo sapiens
  misc_feature: GZ8MTXP01BYT6P.51.76.G10.1.454.CMB.2.raw
  modified_base (429)..(429): a, c, t, g, unknown or other
  misc_feature (429)..(429): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctctgcatagtattggatacaactattggattggcacctgccagagccgagggcagtcctccacaggtcctagattcttagtttgacgtttacgtaacggtccccccgggggccccccggggttcctggaaccgtagggtttccaagggttcggaccgtaagggttgggacttcgaacgggtcaacgtagttaattttaanaacgtagtaaaacttcgaaggacgtaaggaggtgggacgtacgtaggacggttaggttggggtttaggggtttatcgtaagtttgacgtagttacggtactaacggtccttaacctaacctaaacccttccttacgttaacggttccggttttaccggggacgggttaaacggggttccgaagggttcggaagtcgttacggaacgttacgtaacgttggtaaccgg

SEQ ID NO: 328964 - DNA, 787 bp, Homo sapiens
  misc_feature: GZ8MTXP01DJE9K.51.76.G10.1.454.CMB.2.raw
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcggtgggggagcgtggtccaggcccgggagtcccctgacgtactctcctgtgccagtccctcgtggtattccaccttnagtgcccttatggcatgcctacgtcgggccccnccgagggcctaccggagggcggaaagggggtcgtagggacggtgggggttgacttagttttatacgtacagtagtgagttagggaactaaggttaaaataaagggtagttaactcggtacgttaacgggttcccgttacccggggtagggtaaacccggggtcccgttaactttaccccaaacccgtacttaccccgtaacccgaaagggtaaccgtaaaccctaaacccgttaacccccgaaaaggtaaacccgtaaacccttaaccgtttaaacgtacctttaacgtaaaccggaaacctaaaaaagttacggaaaaccgtaaggttaacgttaagggaaggaacgtaacggttaacgggaacgggttaaccgtaccggggttactttacgggtttagtttaccgttttcgtaaggttaaccggaaaacccggttaaaacgttcgttaagggttaacggggttaaaggggg

SEQ ID NO: 328965 - DNA, 594 bp, Homo sapiens
  misc_feature: GZ8MTXP01EGTHC.51.76.G10.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (578)..(578): a, c, t, g, unknown or other
  misc_feature (578)..(578): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccacctctcctgcagggccagtcagagtgttagcagcgattagcctggtaccagcagaaacctggccaggctcccaggctcnatctangatgcatccagaaggcccagtgatactcccagccgtaggtcagtggctaggtgggttctggggactaggacgttcactctcaacctatcaggcagtccctggactagttctagaagttatttagtacttaattttattactttaggtactaggactaaggtaattaaacgttaaacgtccggtccgttacccgtaacgttaccgttttaacgggaacccgttaggggtaacccaaaggtccgttaagggacgttacgttacgaaaacgttaccgtaagtcggaccgttanaacccgttaacttccg

SEQ ID NO: 328966 - DNA, 555 bp, Homo sapiens
  misc_feature: GZ8MTXP01AJQNI.51.76.G10.1.454.CMB.2.raw
  modified_base (254)..(254): a, c, t, g, unknown or other
  misc_feature (254)..(254): n is a, c, g, or t
  modified_base (502)..(502): a, c, t, g, unknown or other
  misc_feature (502)..(502): n is a, c, g, or t
  modified_base (530)..(530): a, c, t, g, unknown or other
  misc_feature (530)..(530): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggagcgtggtccaggcccgggagtccctgagctctcctgtgcagcctntggattcaccttcagtgcctatggcatgcacgtcgggtcccgccgaggcctccgaggcgaagggggtctgggagtggggtggctagtttatatcagatgagtggactaaagtaaataagagtatgactagtctccggtaggacgggcgtattcacctatctaccagacgacaacttcccaagaacacacgtcgtatcagtacaatagaacagtatagagacgcgtaaggaggacgacggttcgtggtnttacgtttcgttgtaacgacgaaacgtntaggagtaagggttgggttaagggg

SEQ ID NO: 328967 - DNA, 702 bp, Homo sapiens
  misc_feature: GZ8MTXP01DJDTY.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactcctccctgccccgtcaccccgtggagacgccggcctccatcctctgcaggtctagtcagacgtcctctgctatagtatggatactaatattggattggctacgtgacagacgccgaggcagtccacacgtacgtcctagtactctttagtttcgtacgttacgtaccggtccccccggggtcccccggttcgtagacgtacggttaccgagggttgggacgtagggtacgggtactacgggacggtacctaacgttaagttttaacttttaacgtaaacgtaaaggtaaacttaccggaaaggttacgaagggttaaggggtaccgggaaggtacggttaaggggtagggtttacggggtttttagggggttttaggggttttaaactcgttaagtttggactagttaccggactaacgttacctacctaaactaaacccgtttcttacggtaacggttcggttacggggtacgggaacggttacggttaagggtggtaacgtaagtaacggacggttaccgtaacgttgggtccg

SEQ ID NO: 328968 - DNA, 572 bp, Homo sapiens
  misc_feature: GZ8MTXP01DBS2B.51.76.G10.1.454.CMB.2.raw
tcagcgatcgtatacacgaccggtgctcgatttagtcactcatacagggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctcatctcctgcaggtctagtcagagcctcctgcatagtattggatacaactattggattggcacctgcagaagccagggcagtctccacaggtcctgatctatttgagttctaacgtccccgggcccccggggtctgacaggttcagtggcaggtggatcgaggcacagtatttatactagaaatcgaagcagagtggaggctaggaggtagttaggtttggggtttaattcgtaagttgctagtaggcctaaagtcctactaacctaaaaccttcccttagtaacgacgttttccgggggacggttaagggggacccgaaaggggttcgggaaagtaacgttaccgaaaggttaccggtaaaccgttggtggg

SEQ ID NO: 328969 - DNA, 648 bp, Homo sapiens
  misc_feature: GZ8MTXP01BPZ2H.51.76.G10.1.454.CMB.2.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctctggacttccaccttcagtcgcctagtggcatgcacgtggggtccccncaggcctaccgaggtcgaagggggctgggacggtggggtgactattttanactcgagtatcggagtgggaactaagttaaaataaaggacgttatcgactaagtccgtaccgtaggaacgggtcctattaccactacgtcctaccgaagtacgaacctaacttacccaaagaaccgtaactacctagttactaccgtagaacctaaagttaccgaacgtaagtagttaggaaggtaacgtcgaagggaacggaccgtaaacgggtccgtttagggttcgtttacgtttcggtaggttaacggaacccgtaaaacggttccgtttaaggttgggttaaagggggg

SEQ ID NO: 328970 - DNA, 594 bp, Homo sapiens
  misc_feature: GZ8MTXP01BG4AK.51.76.G10.1.454.CMB.2.raw
  modified_base (198)..(198): a, c, t, g, unknown or other
  misc_feature (198)..(198): n is a, c, g, or t
  modified_base (411)..(411): a, c, t, g, unknown or other
  misc_feature (411)..(411): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaacctggccaggctcccaggcctcctcatctatgatgcatccacgagggccagtgatactcccagccgtaggttcaggtggacgtaggtggggtctggggacaggtacgtttcacgtctacgacctatcagcagcctgacagtctagtaagttntttagactttaagtttattactcggtacagtactaagttaacttaacgtaaccgttcggtacccttacccggttaactaccgttttcgggacccggttaaagggggaaccccttaaggcggttaggaacgttacttaccgaaaacggtacgtggacgggtacttcggaaccttaaccgtaacg

SEQ ID NO: 328971 - DNA, 619 bp, Homo sapiens
  misc_feature: GZ8MTXP01AZOEE.51.76.G10.1.454.CMB.2.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctntgattcaccttnagtgcctatggcatgccacgtcgggtcccncaggcctcgaggcgaaggggctgggagtgggtgctatttanatcgagtatgagtggactaaaagtaaataaggngtaatcggactagtccgtaccggtaggtaacgggccgtaattaccgacctatcctaccgaagtacgaacctaacttaccccgaaacgtaacctaacctacgttaggttaacttacctacggtaaaccaaagttagaaacgtagtataggagtacgcgtaagaacggttacgacggttgtaggttagttacgttcgttacggtaacggaccgtaacgtgtaggttagggtaagggttaagggtaaggg

SEQ ID NO: 328972 - DNA, 559 bp, Homo sapiens
  misc_feature: GZ8MTXP01BJFO8.51.76.G10.1.454.CMB.2.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagagtgtagcagcgacttagcctaggtaccagacagaaacctggaccaggcctcccaggcctcctcatctatgatgcatccanaaggccatgatacnccagcctaggttcagtggcaggtgggtcgtgggacagtagttcactctccacatcagcagtcctgacagttcgtagaagttatttacgacttaatttattacgtgtactagtactaagtaataataacgtcgtacctacgttactacgtttcggaccgttaaggggtaccgaacgtacgttagggaacgttacttaacgaaacgtaacgtcggtacgggtcttacgaacgttaactaacg

SEQ ID NO: 328973 - DNA, 624 bp, Homo sapiens
  misc_feature: GZ8MTXP01C944I.51.76.G10.1.454.CMB.2.raw
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgagactctcctgtncagcctctggattccaccttcagtcgcctagtcggctagtgcacgtcgggtcccncgaggcctccgagggcgaagggggctgggaggtgggtgactatttanactcgagtntgagtagggactaagtaaataaagggactagngactagtccgtccggtaggacgggcctattaccgacctatcctaccgaagtacgaactaacgtacccaaagaacctaacgtacgtacgtactactacgaacaaagttacgaaatagtatacggaagtaacgcggttacggaaacgggttacccgtaaagggttcttaagggtttcgtttaatttaacgtaggtcgtaacccgaaagttccgtaaggttaagggtaaggggg

SEQ ID NO: 328974 - DNA, 556 bp, Homo sapiens
  misc_feature: GZ8MTXP01BZWV6.51.76.G10.1.454.CMB.2.raw
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctctttaagaggtgtccagtgtcaggtgcagctggtggagtcgtgggggagcgtggtccaggcccgggaggtccctgagactctcctgtgcagcctctggacttcaccttcagtgcctatggcatgcacgtgggtcccnccagggcctaccgagggcgaaggggggctggggaggtggggtagctagtttanatcagatgaatgggactaaggtaaataaaggagtactggacaggtcctccggtaggaacgggccgtattaccacccatcctaccaagacgacaacttaccaagaacactactgtatcgtgacaatagaacagtatcgagngcttaggaggcgtacggtnttgttcgttattctggtaacgacgaacgttctaagttggtaaggg

SEQ ID NO: 328975 - DNA, 751 bp, Homo sapiens
  misc_feature: GZ8MTXP01BYJUH.51.76.G10.1.454.CMB.2.raw
  modified_base (200)..(200): a, c, t, g, unknown or other
  misc_feature (200)..(200): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaangcccaccctctcctgcagggccagtcagagtgtagcagcgacttagcctggaccagcaagaacctggccaggcctccaggcctcctcatctatgatgcataccacgaggcccatgatactcccagccgtaggttcagtggcgtaggtggggtctggggacaggtacgtttaccaccgttctaccgaaccctacgtaccgaacggtaccgacggtccccgtggtaccgtacggtttaccgtaagggttaaacggtttatttttaacgggtaaccttttaaacgtttttttaagtttaaccccgtttagggtttacctaaacgggttaaccttaaaagggtttaaactttaaaacgtttaaacccggttcccggttaaccccgttttaaccccggtttaacccgtttaaccgggttttttaaccgggggaaccccggttaaacggggggtaaccccttaaagggtacccgtttaagggggaacttaaccgtttaaccgaaaaccggttaacgttcgggtacggtacgttacgggtaacccttaacccgttaag

SEQ ID NO: 328976 - DNA, 609 bp, Homo sapiens
  misc_feature: GZ8MTXP01DLNFE.51.76.G10.1.454.CMB.2.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggcccgggagtccctgacgactctcctgtgcagcctcgtgacttccaccttcagtcgcctagtggctatgcctacgtgggtcccnccgaggcctaccgaggcggaagggggtctggggaggttgggngacttattttagatcgaagatgagtggactaaaaggttaaataaggagtatcgacgtagttccgtacggtaggacgggctacttacacctatcctacgagacgaacctaactacccaagaacacctaggttcgtattcctagaactaaagngaaactagattagagtacgcgtaagggacggaacgtaccggttgttgttacttacgtttgttaggtaacgaaccgtaaacgtgtaggttgggtgggttaagggtaagggg

SEQ ID NO: 328977 - DNA, 511 bp, Homo sapiens
  misc_feature: GZ8MTXP01CIAT3.51.76.G10.1.454.CMB.2.raw
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcactgggtcccgccaggcctaccgaggcaagggggctgggagtgggtgcatttanactcgagatgatgganaagtaaataaagngtatgcagtctcgtgaaggccatcacatcncaganacaatcccaagaacactaactgtaatcagacaaatcgaaatanagtagagaagacgngaggacgacgtcgttgttgttagttntgtgacgacgacgtaagttggtaagg

SEQ ID NO: 328978 - DNA, 661 bp, Homo sapiens
  misc_feature: GZ8MTXP01A1DLA.51.76.G10.1.454.CMB.2.raw
  modified_base (188)..(188): a, c, t, g, unknown or other
  misc_feature (188)..(188): n is a, c, g, or t
  modified_base (258)..(258): a, c, t, g, unknown or other
  misc_feature (258)..(258): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggcccgggagtccctgacgtactctcctgtgcagcctntgtattccaccttcagtgcctatggcatcgcacgtcgggtcccgccaggcctaccggagggccgtaaaggggggtctaggggtagggttgggggtggacttaagttttatatcgaagtattggaatcgggactaaaagttaaanaaggtggtaatcggactacggtcccgtcgggtaaggtaaacgggccgtaattccgaacctactcctaaccgaacgtaacgaactaaaccgttacccaaggtaaaccacctacggttacgttactcgtacgaactaaacgtgtaaaccgtagtagttacggacgtaagccgttaaggacggaaccgtacggttccgttaggtacgtttagtttcgttaggtcgacgtaacgtcgtagagggtaaggttgggttaaggggg

SEQ ID NO: 328979 - DNA, 570 bp, Homo sapiens
  misc_feature: GZ8MTXP01BH73H.51.76.G10.1.454.CMB.2.raw
  modified_base (293)..(293): a, c, t, g, unknown or other
  misc_feature (293)..(293): n is a, c, g, or t
  modified_base (412)..(412): a, c, t, g, unknown or other
  misc_feature (412)..(412): n is a, c, g, or t
  modified_base (557)..(557): a, c, t, g, unknown or other
  misc_feature (557)..(557): n is a, c, g, or t
  modified_base (570)..(570): a, c, t, g, unknown or other
  misc_feature (570)..(570): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtcctccgaaggggaaacagcccaccctctcctgcagggccagtcagagtgttagcagcgtacttagcctaggaccagcaaagaacctggccaggcctccgaggcctccncatcatgatgacatccagacggccatgactactcccagcctaggttcgaggtcgcgtagggtcgggtacgtggggactaggtacgtttaccactcctcaaccatcaacggcacgtcccngtaccgtagtcgtaggtaattactttagaattaactttattactgtaccaagtactaagtaactaataacgtcggtacctaccggttactcgttgggacccgaggggtaccaggcgtaggagcttaacgaagtacgtggtcgacncgtaacaaccttn

SEQ ID NO: 328980 - DNA, 590 bp, Homo sapiens
  misc_feature: GZ8MTXP01ERT5E.51.76.G10.1.454.CMB.2.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccatggagaagtagtgatgacgcagtctccagccaccctgtctgtgtctccgaggggaaangcccaccctctcctgcagggccagtcagagtgtagcagcgtacttagcctggtaccagcaagaaacctggccaggcctcccgaggcctcctnatctatgatgcatccaacgaacggcccaatgactacncccagcctaaggttcaggtggactagggtcgggtcgtggggaacaggtacgttccaacttcacaacntacgagcacgtcctagactagttctagtaagttatttgaactttaatttacttacgtgttacagtactaagttaattaaacgtaaccgttcggtaccctttacgtacttacggtttgggaccggttaaggggaaccaggtccgtaaggacttacgttaacgaaagtacgtgggagtcacgtaaccttaaccgttaag

SEQ ID NO: 328981 - DNA, 587 bp, Homo sapiens
  misc_feature: GZ8MTXP01B5LWC.51.76.G10.1.454.CMB.2.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
  modified_base (316)..(316): a, c, t, g, unknown or other
  misc_feature (316)..(316): n is a, c, g, or t
  modified_base (551)..(551): a, c, t, g, unknown or other
  misc_feature (551)..(551): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccaccctctcctgcagggccagtcagagtgttagnagcgacttagcctggtaccagcagaacctgccagctccagctcnatctatgatgcactccaacgacggcccatgactacncccgagcctaggttcgaggtggcgtaggtcggggttcgtggggactacgtaggtttaccacgttctaccaacctatccgacggccgacggtcccttgaccgtagttccgtaggtaaagttacttttgtaactttaaagttttactttaacgtgttacgaagtacctaaagttactaaagtacgtcgtacctaccggttactcggttcggacgttagggaccaagtccgtaggacncttaacgaagtcgtggtcgacttgaaccttaacgtc

SEQ ID NO: 328982 - DNA, 578 bp, Homo sapiens
  misc_feature: GZ8MTXP01AZDB8.51.76.G10.1.454.CMB.2.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (454)..(454): a, c, t, g, unknown or other
  misc_feature (454)..(454): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctgattcaccttnagtgcctatggcatgcacgtgggtcccncaggcctcgaggcgaagggggctgggagtgggtgctagtttantcagatgagtggacaaagtaataagagtactgctagtcgtccggtaggaacgggccgtattcacctatcctaccgagacgaacctacttacccaagaaccacactagtatcgtanaacaaagtacgaatagtatagaagagtcgtaaggaaggacgtaaccggttgttggttagttacgtttcgttggtaagacgtaaaccgtgtaggttagggtaaggggttaaggggtttaaggggg

SEQ ID NO: 328983 - DNA, 587 bp, Homo sapiens
  misc_feature: GZ8MTXP01BLECX.51.76.G10.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccgggaggtccctgagacctctcctgtgcagcctctggattccacttnagtgcctatggcatgccacgtgggcccncgngcctaccgaggcgaaggggctgggaggtgggtcgactatttanatcagtagtgagtggacaaagttaaanaagngtancgactagtcctcggtaggacgggtcctataccactatcaccgagacaactaactaccaagacactacggtntactccagtaacaaagtagaacgtaatgtaggaaactcgggntaagggaacggttcaacgggttcttgggtactttagttccggaggtaacaaccgggtaatagtggttagggtgggtttaacgggggtaagggg

SEQ ID NO: 328984 - DNA, 549 bp, Homo sapiens
  misc_feature: GZ8MTXP01C6C5L.51.76.G10.1.454.CMB.2.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (508)..(508): a, c, t, g, unknown or other
  misc_feature (508)..(508): n is a, c, g, or t
  modified_base (541)..(541): a, c, t, g, unknown or other
  misc_feature (541)..(541): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttggggttttcctcgttgcttctttttaagaggtgtccagtgtcaggtgcagctggtggagtcgtggggggagcgtggtccagcccgggagtccctgagactctcctgtgcagcctntggattcaccttnagtgcctatggcatgcacgtgggtccnccaggctccgaggcaagggggctgggagtgggtgctatttanatcaagntgatgggacaaggttaaataaaggagtactgactagtccgtccgtagaacggggcctattcacccatccctaccaagaacgaacctaacttacccgaagaacactactgtatctagacaaatagaactagagtgacgaagcttaggacgacgtacggtnttagttgttattcgtgtgacgaaagttctaagnggtaaggg

SEQ ID NO: 328985 - DNA, 573 bp, Homo sapiens
  misc_feature: GZ8MTXP01AI94V.51.76.G10.1.454.CMB.2.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (539)..(539): a, c, t, g, unknown or other
  misc_feature (539)..(539): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcccgggagtccctgagctctcctgtgcagcctntggattccaccttcagtgcctatggcatgcacgtcgggtcccncgaggcctccgaggcgaaggggctgggacggtgggngctagtttanactcgagtatgagtgactaagtaaataaagngtatggacagtcctacgtagaacgggcctagttccactactcctaccaagacgactaacttccccgaagaacactactgtacttcgacgaactaaatacgaaactagtaattggaagaagtacgttagggaacgcggaacggtcttggttattacctttaaggnggtaacgtacgacttaggtaaggttgggtaaggg

SEQ ID NO: 328986 - DNA, 766 bp, Homo sapiens
  misc_feature: GZ8MTXP01ADMK4.51.76.G10.1.454.CMB.2.raw
  modified_base (275)..(275): a, c, t, g, unknown or other
  misc_feature (275)..(275): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagtcttgggtttttcctcgttgcttcttttaagaggtgtccagtgtcaggtgcagctggtggagtcggtgggggagcgtggtccacggcccgggagtccctgacgactctcctgtcgcagcctctgacttcaccttnagtcgcctatggctatcgccacggttcgggtccccgccgacgggtccctaccggaggggcggaaacggggggtcttagggggtacgggttgggggtacggtacttaagttttaatacgtacgaaggtatggaagttacggaagtaaaaagtaaaagttaaggtagttactacggacgtacgttaccggtaccgggtaagggaacgggtacccgtaacttaccgaccgtactccctaccgaagtaaccgtaacctaaacttaccccgaaagaacctaaccgtaacgttacgtaacttacgtaacggaaacctaaaagtacgaaacgtaacggttagttaggaaaggtacgtaggtaaacggaacgggttaaccgtaccggttagtttcgtttaacgtttaccgtttttcggttacggttaacggaaaccgggtaaaacccgtttacggttagggttaagggttaacgggggttaaggggtttaaaagggggg

SEQ ID NO: 328987 - DNA, 594 bp, Homo sapiens
  misc_feature: GZ8MTXP01BQUOT.51.76.G10.1.454.CMB.2.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
  modified_base (566)..(566): a, c, t, g, unknown or other
  misc_feature (566)..(566): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtcccaggccccgggagtccctgagtcctctcctgtgcagccctctggacttccaccttnagtcgcctagtggcatcgcacgtcgggtcccnccgaggcctacgaggcgaagggggtctgggaggtgggtgacttatttanagtcaagngtgagtggactaaaagtaaataagntangctgtcgtcggagacggctactcacgtctctacgagaacgacctaacttaccccaagtaaacccacgtacgttacgttaaactccgtaagaaactaaagtacgaaagaagtatggaagtgcgtaaggacgaacgtggttntaggttcttacgtttcgnggtaacgaactaacgngtagttagggtaacgggttgggtaaggg

SEQ ID NO: 328988 - DNA, 527 bp, Homo sapiens
  misc_feature: GZ8MTXP01B2XMB.51.76.G10.1.454.CMB.2.raw
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcccgggagtccctgagactctcctgtgcagcctctggattcaccttcagtcgcctatcggcatgcacgtgggtcccgccaggcctccgaggcgaagggggctgggagtgggtgctatttanatcagatgatgganaagtaaataaagntatgcagtctcgtgaagggcatcacatctacaganacatccaanacacactgtatctnacaaatacgaatagattgagaagtcgttggaacgacgacgtcgttagttcgttagttttcgnggtaacgacgtaaacgttcgttaaggttggtaagggg

SEQ ID NO: 328989 - DNA, 625 bp, Homo sapiens
  misc_feature: GZ8MTXP01DMQ68.51.76.G10.1.454.CMB.2.raw
  modified_base (269)..(269): a, c, t, g, unknown or other
  misc_feature (269)..(269): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattcaccttnagtgcctatggcatgcacgtcgggtcccgccaggcctaccgagggaccgaagggggctggggaggttggggtcggactaattttanatcgaagattgatgggactaaaagttaaataagagtatcggactaggtccgtcggtagggaacgggtcctaattccactaacttccgaacccgagaacgaacctaacttacccaaagtaaccacctacttacgtactacctagaacctaaagtagaaataagtataggagtagtcggtaagaacggacgtaccggttcgttaggttagttacgtttcgttagttaacgaacgtaaaccgtgtaagttggtaagggttgggttaaaggggg

SEQ ID NO: 328990 - DNA, 609 bp, Homo sapiens
  misc_feature: GZ8MTXP01A7LQ4.51.76.G10.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (573)..(573): a, c, t, g, unknown or other
  misc_feature (573)..(573): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctctgtgcagcctntggattcaccttcagtgcctatcggcatgccacgtgggccnccaggcctcgaggcgaggggctgggagtgggtgctatttanactcgagtatgagtgggactaagtaaagtaaaggagttactgactaggttccctaccgggtagaacggggcctattaccaacctagtacctaccgaagtaacgaacctaaactaccccaaagaaaccctaacgacgttagtaacttacgtaaccgaataaacgtaacgaaactaaggtaacgttgaaacggtgaccgaagggaccgaacgcgggttattagtttgttatttccgnggttaacgaacggaaacttgtaagttgggtaagggg

SEQ ID NO: 328991 - DNA, 685 bp, Homo sapiens
  misc_feature: GZ8MTXP01B9D7D.51.76.G10.1.454.CMB.2.raw
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgactctcctgtgcagcctctggacttccaccttcagtcgcctagtggcatgctacgtgggtcccncaggcctccgagggcgaagggggtctaggggaggttggggtgcttaagttttanagtcagtagtgagtcggaactaaaagttaaataaggagttaacgtggactagggttccgtaccgggtagggaaccggggtcctaacttacccgacctactcccgtaacccgaaggtaacaaacctaaccgttaccccaaagaaacctactaacggttacgttaacttccgtacgaaacctaaagtacggaaaccgtaagttagttaggaagacgtcggtaaggaaccggttacgtacggttcgtttggttacgtttacgtttcgttacggtaacgaacggtaaaccgttggtaggttaggggtaaggggttaacggggtttaaagggg

SEQ ID NO: 328992 - DNA, 613 bp, Homo sapiens
  misc_feature: GZ8MTXP01BNFUD.51.76.G10.1.454.CMB.2.raw
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
  modified_base (581)..(581): a, c, t, g, unknown or other
  misc_feature (581)..(581): n is a, c, g, or t
  modified_base (602)..(602): a, c, t, g, unknown or other
  misc_feature (602)..(602): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcacgcctgtggacttccaccttcagtcgccctatcggcatcggctacgtcgggtcccnccgaggcctcgaggccgaagggggtctgggagtgggtgactatttanactcagagtgagtgggactaagtaaataaagagtatcgactagttccgtcggttagaaccggggcctactttaccaaccgtacttccgtaccgaagaacgaaacctaaccgttacccgaaacgtaacctaacgtacgttacgtaactttaccgagaacctaaagtacgaaatagtaattagaagtaacggcttaggaacgacgtacgtcttgttgtttatttccgngtaacgacaacgttgttaagngggtaacgggg

SEQ ID NO: 328993 - DNA, 672 bp, Homo sapiens
  misc_feature: GZ8MTXP01AUZGC.51.76.G10.1.454.CMB.2.raw
  modified_base (275)..(275): a, c, t, g, unknown or other
  misc_feature (275)..(275): n is a, c, g, or t
  modified_base (438)..(438): a, c, t, g, unknown or other
  misc_feature (438)..(438): n is a, c, g, or t
  modified_base (597)..(597): a, c, t, g, unknown or other
  misc_feature (597)..(597): n is a, c, g, or t
  modified_base (621)..(621): a, c, t, g, unknown or other
  misc_feature (621)..(621): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctctgtgcagtcctctggtacttccgacccttnagtcgtcctagtcggctagtcgacctaccggtcgggtccccgaccacgggcctacccgagggacccggaaaggggggtcccttagggggacggttgggggtacggtcttaaaggttttactacgtacgtaaagtgtaggaacgtacgggactaaaggttaaanaaaagggtacttaacgtgtaccgtaaggttcccgtacgggtagggaaccgggtcgtacttaccaactacgtctaccgaggaacctaactaacctaccgaaataccactacgtagtactcgtagtaaccaaagtacaactaggtaatacggaggaaccgngttaggacggttaacgaccggttnttgttgttacgttcggagtaaccgacgtacgttagtaaggttgggtaaggg

SEQ ID NO: 328994 - DNA, 663 bp, Homo sapiens
  misc_feature: GZ8MTXP01DUFOZ.51.76.G10.1.454.CMB.2.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgacgactctcctgtgcagctctgacttcaccttnagtgcctanggcatcgcacgtgggtcccnccgaggcctaccgagggacgaagggggtctgggaggttggggtggacttaagttttanagtacagtatgagtacggactaaaagtaaagtaagagtacgtcgactacggtccgtacggtaggaacggtcgtactaccaacctactccgtacgagtacgtaaacctaactacccgaaagaaacctaacctacgttacgtaacttactaacgaaactaaacgtagaaacgtaagttagtaggaacgtacgtacgtaaggaaccgggttacgtacggttcgttaggtttacgtttacgttttcggttacggtaacggtaaaccggtaaacgttagtaggttacgggtaaggggttaaggggttaagggg

SEQ ID NO: 328995 - DNA, 553 bp, Homo sapiens
  misc_feature: GZ8MTXP01EG05C.51.76.G10.1.454.CMB.2.raw
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccaggcccgggagtccctgagactctcctgtgcagcctctggattccaccttcagtcgcctatggcatgcacgtcgggcccacaggcctccgaggccgaagggggctggagtggggtgctatttanancgagatgagtcgataaaagtaaataagagtacgtgacgtacgtcgtacggaggaacggcctatacactatcacagaacactaactccaaanaacactacttagtactcgagaacaataagaanaagtagtagagagagaagagacgacgttcgtgtgttagttcgttagtaagtacgtaacgtacgtagttaggtaagggttaagggtaaggg

SEQ ID NO: 328996 - DNA, 604 bp, Homo sapiens
  misc_feature: GZ8MTXP01BG510.51.76.G10.1.454.CMB.2.raw
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (378)..(378): a, c, t, g, unknown or other
  misc_feature (378)..(378): n is a, c, g, or t
  modified_base (572)..(572): a, c, t, g, unknown or other
  misc_feature (572)..(572): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctganacctctccgtgtgcagcctgtgattccaccttnagtgcctanggcatgcacgtggtccgcgaggctcgtaggcgaagggggctgggaggttggggtgacttagtttatatcaagtatgagtggactaaaagttaataagngttaagcgactaggttcgtaccggtaggaacggtccgtacttacacctactcgtaccagtacgaacctaactacccgaataaaccactactagtaactccagtaaacaaacgtagaacgtaagtagtacgaagaggcgtaaggaacggacgacgttgttgttaagtttgtttccgttgtaacgaacgtaacgtnttaggagggtaacgggttaaggggttaagggg

SEQ ID NO: 328997 - DNA, 542 bp, Homo sapiens
  misc_feature: GZ8MTXP01DOW2E.51.76.G10.1.454.CMB.2.raw
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (467)..(467): a, c, t, g, unknown or other
  misc_feature (467)..(467): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggaggtcgtgggggagcgtggtccaggcccgggaggtccctgagctctcctgtncagcctctggattcacttcagtgcctagtgcatgcacgtcgggtccnccaggcctccgaggcgaaggggctgggagtgggtgctatttanactcagtntgacgtgactaagtaaataaagagtatgcgagtctcgtagacgggcattcacatctacagacaacacttacccagaacacacttgtacttcagactaaagtacgatagtaatcgaagngtcagggaacgttacgacggtcttgttggttatttcgaggtaacggtacgaaaccgttgtaagttgggtaagggg

SEQ ID NO: 328998 - DNA, 644 bp, Homo sapiens
  misc_feature: GZ8MTXP01BXHY1.51.76.G10.1.454.CMB.2.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (582)..(582): a, c, t, g, unknown or other
  misc_feature (582)..(582): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttctttttaagaggtgtccagtgtcaggtgcagcgtggtggagtcgtgggggagcgtggtccaggcccgggagtccctgacgactctcctgtgccagcctgtggtacttccaccttgagtgcccttatggctatcgcctacgtcgggtcccnccgaggcctaccgagggacgaagggggtctagggaggtgggtgtactatttanactcgagagtgagtacgggataaggtaaactaaagcgttagtcgactaaggttcctaccggtagaacgggtactacttaccaaccgtactacctaccgacgaaactacctaaaccttaccaacgaaacctacgtaacctagttaactctagaactaaagtagaaactagtataggaagaacggtacgttaggaacggacgaacggttcttgggttnttacgttttcggtaggtaacggtaacgggtaaaccgttcggttaaggttgggttaaaggggg

SEQ ID NO: 328999 - DNA, 692 bp, Homo sapiens
  misc_feature: GZ8MTXP01CZYRO.51.76.G10.1.454.CMB.2.raw
  modified_base (358)..(358): a, c, t, g, unknown or other
  misc_feature (358)..(358): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgacgactctcctgtcgcagcctcgtggattccaccttcagtcgcctatggcatcgccacgtcgggtccccgcgaggccctcggaggcggaagggggctgggtacggtgggtcgattagtttaanatacgagtagtagtagtaggtaataaaaagttaaaagtaaggtacgtagtacggtacgtacggtaccgtacgggaacgggaccggtaccttacgtacctactactaccgtaacgaacgtaaactaaacctaaccgtaaccaaacgtaaacctacgttaacggttacgtaacgttacaacgtaaactaaacgtaacgaaacgtaagtacgtaaggaagtacgtaacggtaagggaaacggttacggtacggttcgtttagtttacgtttacgtttcgagttaacggaaaccgtaacgtacgttaggttacgggtaaggggttaaggggttaaggg

SEQ ID NO: 329000 - DNA, 770 bp, Homo sapiens
  misc_feature: GZ8MTXP01AVEZU.51.76.G10.1.454.CMB.2.raw
  modified_base (293)..(293): a, c, t, g, unknown or other
  misc_feature (293)..(293): n is a, c, g, or t
  modified_base (693)..(693): a, c, t, g, unknown or other
  misc_feature (693)..(693): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgactctcctgtcgcacgcccctggacgttctacctctagtgccgtactaggcntagccacgtgggtcccgccacggtcgtccgacggacggaacgggggtcgtgggtaagggggtggggtacgggtacctaatttagtatacccgagagtgagtagaacgtaagtaagtaaagtagtacgttcgacgtacggtacgtccggttacgggaaacggtacccggtactactaacccaactttaccgtcccggaaacggacgtaaacctaaaccgtttaaccccaaacggaaacccgtaccgttaaaccttaggttaaccgttaccttaaacgggaacccgaaaaaactttggaaaaaaccgtaggtaaacgttttacggaaacgggtaaaaggcccggtttaaggggaaccgggaaacccggttaaacccgggttacgtttgggttacccggtttnttttaacccggtggttacgggaacccgtaaacccggtacgttaaacgggtcggggttaacgggtttaaagggggggg

SEQ ID NO: 329001 - DNA, 579 bp, Homo sapiens
  misc_feature: GZ8MTXP01BCR0Z.51.76.G10.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (529)..(529): a, c, t, g, unknown or other
  misc_feature (529)..(529): n is a, c, g, or t
  modified_base (544)..(544): a, c, t, g, unknown or other
  misc_feature (544)..(544): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtncagcctgtggtattcaccttcagtcgcctagtggctatcgcacgtcgggtcccncgaggcctccgaggccgaagggggctgggaggtggtgactagtttanctcagntgaactgggactaaggtaaataaagagtatggctagtcctacggtagacggaccgtattccgactactctaccaaggacacctaacgttacccaacgaaactacgtacgtagtactacgtagaactaaagtacgaataagtagttagataagcgttagggacgcggtaccggtnttgttagttcgtttntgtaacgacgaacgttctaaggttaaggtaagggg

SEQ ID NO: 329002 - DNA, 553 bp, Homo sapiens
  misc_feature: GZ8MTXP01BLW1O.51.76.G10.1.454.CMB.2.raw
  modified_base (257)..(257): a, c, t, g, unknown or other
  misc_feature (257)..(257): n is a, c, g, or t
  modified_base (380)..(380): a, c, t, g, unknown or other
  misc_feature (380)..(380): n is a, c, g, or t
  modified_base (507)..(507): a, c, t, g, unknown or other
  misc_feature (507)..(507): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtcccctgagactctcctgtgcagcctntggacttcaccttcagtcgcctatggcatgcacgtcgggtcccgccaggcctccgagggcgaagggggctgggaggtggggtgctatttatactcagtatgagtgggactaagtaaataaagngtatgctagtctccggtagaacgggcctatccactactcctaccagacactaactacccaagaacgaactactagtactctagactaaatagaactagattagagaagcgttaggacgacgacggtnttgttgttattcgtgtaacgacgtaacgttgtaagttggtaagggg

SEQ ID NO: 329003 - DNA, 783 bp, Homo sapiens
  misc_feature: GZ8MTXP01BJ178.51.76.G10.1.454.CMB.2.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgactctcctgtgcagcctntggattcaccttcagtncctatggcatcgcacgtcgggtccgccgaggcctccgagggccgaagggggcctaggggtaggtggggttacggactaattttacgaaccgttnaaggtagtaggagttaggggaacaagggttaaaattaaaagggtacgttaaagtcggtacgtacggttacccgtcccgggtaagggtaaaccggggtacccgtaacgtttaacccaacccgttaacttacccgttaaccggaaacgtaaacgaaaccctaaacctttaccccgaaacggtaaacccgtaaacgttaaccgttacggtaaactttcccggaaagttaacccaaaagttaaaggtaaaccgaaggttaaacgttagggaaacccggaaggtaccggttaaggggaaccggggttaaacgtaacccggggtcgtttaacggggttgttttaaacccgttttgggttacgggtaacggtaacccggttaaaaaccggttcggtttaagggttcgggttaaagggggg

SEQ ID NO: 329004 - DNA, 606 bp, Homo sapiens
  misc_feature: GZ8MTXP01ESG65.51.76.G10.1.454.CMB.2.raw
  modified_base (152)..(152): a, c, t, g, unknown or other
  misc_feature (152)..(152): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (355)..(355): a, c, t, g, unknown or other
  misc_feature (355)..(355): n is a, c, g, or t
  modified_base (518)..(518): a, c, t, g, unknown or other
  misc_feature (518)..(518): n is a, c, g, or t
  modified_base (583)..(583): a, c, t, g, unknown or other
  misc_feature (583)..(583): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttccncgctgcttcttttaagaggtgtccagtgtcaggtgcagcgtggtggagtcgtgggggagcgtggtccaggcccgggaggtccctgagtactctcctgtncagcctcgtggacttcaccttnagtcgcctagtggcagtcgccacgtcgggcccgccgaggcctccgaggcgaagggggcgtgggaggtggggtgtctatttanatccagtatgatcggaaactaagtaataaagagtatggactaggtcctacggtagaacgggtcgtacttcaacctactaccgtaccgaagtaaccgaactaaacccttaccgaaacgtaaacctacggtaacttagttactaccgtagaactaaaagtgaaanagtatagagtagaactaggacggacgacgtcgttgttcgtttcttacgtggtacgaacggtaacngttagtggttaagggttaagggg

SEQ ID NO: 329005 - DNA, 569 bp, Homo sapiens
  misc_feature: GZ8MTXP01CE9Q3.51.76.G10.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (517)..(517): a, c, t, g, unknown or other
  misc_feature (517)..(517): n is a, c, g, or t
  modified_base (534)..(534): a, c, t, g, unknown or other
  misc_feature (534)..(534): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcccgggagtccctgagctctcctgtgcagcctctggattcaccttcagtcgcctagtcggcagtcggctacgtcggggtcccnccgaggcctccgaggcgaagggggtctgggaggtgggtgctatttatactnagtntgatagggactaagtaaataaagngtangcagtcctcgtaggaacggcgtattccacacttcgtaccagtacgaactaacttacccaagtaacacgtactntanactagacaaatacgaactagagttgaagtgcgttaggacggacgtaaccggtnttagttgttacgtttcnggttcgaacggtaacggcttaagttgggtaagggg

SEQ ID NO: 329006 - DNA, 617 bp, Homo sapiens
  misc_feature: GZ8MTXP01AEEG0.51.76.G10.1.454.CMB.2.raw
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgactctcctgtcgcagtcctgtggacttccaccttgagtcgcctagtcggacagtcgccacggtcgggtcccnccgaggcctcgaggtccgaaggggctgggacgttggggtgacttatttanatcgagtatgagtcgggataaaagtaaataaggngttagngacgtagtcgtaccgggtagaacgggtcctattcaacctatctacgagaacaactaactacccaagaaccacacggttatactaccgtaaggaaccttaaagaacgaacgaagtaagtagtaagagcgtaacggacggacgtacgttcgttgttagttagttcgttcgtaacggtacgtaacgtagtagttaggtaagggttaagggttaaggggg

SEQ ID NO: 329007 - DNA, 549 bp, Homo sapiens
  misc_feature: GZ8MTXP01BR15V.51.76.G10.1.454.CMB.2.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
  modified_base (483)..(483): a, c, t, g, unknown or other
  misc_feature (483)..(483): n is a, c, g, or t
  modified_base (525)..(525): a, c, t, g, unknown or other
  misc_feature (525)..(525): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccgaggcccgggagtccctgacgactctctgtgcagcctcgtgattccaccttcagtcgcctagtggcatgcacgtcgggtcccnccgaggcctcgaggcgaagggggctggaggtgggtgctatttantcagatgagtggactaaaagtaaataagngtangctagtctcggagacggctatcacatctaccagacgacactaccaagacactactgtactcagaacaanagaacagtatgagngctaaggaggacgtcggttnttggtacttagttcgttggtaacgaacgtaaccgtgttaggnggtaacgggttggggttaaagggg

SEQ ID NO: 329008 - DNA, 607 bp, Homo sapiens
  misc_feature: GZ8MTXP01A9PTA.51.76.G10.1.454.CMB.2.raw
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (354)..(355): a, c, t, g, unknown or other
  misc_feature (354)..(355): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccgaggcccgggagtccctgacgtacctctcctgtcgcagcctctggacttccaccttcagtcgcctagtggcatgcacgtcgggtcccnccgaggcctccgaggccgaagggggctaggaggtgggtgntatttanncagatgagtggactaaaagtaaagtaagagtatgacgtacgtcgtacggtaggaacggtccgtattaccactactctaccaagacgaacctaacttacccaagaaccactacgtagtactactaagaactaaacgtagtaacgaagtattaggacgacggcgtaaggacgacgtacggttgttaggttgttacgtttcgttaggtaacgaccgtaacgtcgtaggttagggtaagggttggggttaaagggg

SEQ ID NO: 329009 - DNA, 746 bp, Homo sapiens
  misc_feature: GZ8MTXP01ACY5V.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccctggagacgccggcctccactcctcctgctaggtctagtcagacgcctctgacattagtattggatactaactattaggattggactaccgtgacaggaacgccgagggctacgtcctccgaactacggttcctagtactttaccgtttagtttacggaacgtttacccgtaaaccggttcccccccggggggtacccccccgggttacctaggaccgtaacgggtttcccgaagggttcgggaccgtagggttacgggaaccttccggaacggggacctaaaccggtaagttttaatttttaaacgaaccggttaaaggtaaaaacgttccgaaaggtaccgaaaggggtaacggttaggggaccgggtacgttaaggggtaagggtttaagggtttggggttttaaccgggggtttataccggtaagtttcggactaaggtcgaaccgtaacgtccttaacctaaccgtaaacttcccttaacgtacggttccgtttacgggacggttaccggttacgttacggaagggtacaacggtacacggttacgtaacgttggccg

SEQ ID NO: 329010 - DNA, 547 bp, Homo sapiens
  misc_feature: GZ8MTXP01E3IIP.51.76.G10.1.454.CMB.2.raw
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (519)..(519): a, c, t, g, unknown or other
  misc_feature (519)..(519): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntgattcacttnagtcnctatgcatgcacgtcgggtcccncaggcctccgaggcaaggggctgggagtgggtgactagtttanatacagtatgatggacaaaagttaaanaagngtangacagtcgtacgtagacggctatcaacctntcacagacactaactaccaanacanacgtntactcganaactaaatgaaatagtagtagagagcgaaggaacgacgtacgngttaggtnttacgtttcgaggtaacgaacgtaacgtntaggttaggtaaggggttaagggtaagg

SEQ ID NO: 329011 - DNA, 574 bp, Homo sapiens
  misc_feature: GZ8MTXP01D8DHI.51.76.G10.1.454.CMB.2.raw
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattcaccttcagtgcctatggcatgcacgtcgggtccnccaggcctaccgaggcgaagggggctgggagtggggtcgactagtttanactcaagntgatgggactaaggtaaataaacggngtatcgactagtcctccggtagaacgggcattcacctatctaccgagacgactaacttacccgaagtaaaccaactactagactctagactaaatcgaaataggtattgaagaagtcgaggacggttacgacgggtcttgggttctttagttcgtggtaacgtacggaaacgttcgtaaggttgggtaagggg

SEQ ID NO: 329012 - DNA, 569 bp, Homo sapiens
  misc_feature: GZ8MTXP01AE9SS.51.76.G10.1.454.CMB.2.raw
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctctggattcaccttcagtcgcctatggcatcgcacgtcgggtccccgccgaggcctccgaggcgaagggggctgggaggtgggtgctatttanactcagatgataggactaagtaaataaagngtatgcacgtctccgtaggaacgggcctatccactatcctacgaagtacaactaactacccaagaaccacactgtaactctagacaaagtacaatagtatgagtaagcgttaggacgacgtacggtcgttgttcgtttagttccgtaggttaacgaaccggtaaacgttgttaaggttgggttaaggggg

SEQ ID NO: 329013 - DNA, 559 bp, Homo sapiens
  misc_feature: GZ8MTXP01ETI31.51.76.G10.1.454.CMB.2.raw
  modified_base (198)..(198): a, c, t, g, unknown or other
  misc_feature (198)..(198): n is a, c, g, or t
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgttagcagcgtacttagcccttaggaccagcaagaacctggccaggcctccagcctctcatctatgatgacatccaagaacggcccagtgatacncccagcctaggtcaggtggacagggtcgggtctggggactagtacgttccactcctacaaccatacaggcagtcctgactagtctaggaattntttnacttaatttacgtactgtacagtataataataactaacgtcggtaccttaccgtacttacggtttcggacccgttaggggacaagtcgtaggaagacttacgaaaactcggtgtacgggcttaggccttaacgtaag

SEQ ID NO: 329014 - DNA, 534 bp, Homo sapiens
  misc_feature: GZ8MTXP01ALE5W.51.76.G10.1.454.CMB.2.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
  modified_base (448)..(448): a, c, t, g, unknown or other
  misc_feature (448)..(448): n is a, c, g, or t
  modified_base (507)..(507): a, c, t, g, unknown or other
  misc_feature (507)..(507): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggcccgggaggtccctgagctctcctgtgcagcctntggattcaccttcagtgcctatggcatgcacgtcgggtcccnccaggcctccgaggcgaagggggctgggaggtggggtgctagtttanatcagatgatggacaaagtaataagngtatgacatcncgtagacggcatcacatcncagacactacgtcccaagaccacacgtgtatctagacaaatcgaanagtatgagagctaaggagacgacggcttggtagttacgtttgagttaagacgaaacgtntagttagggtaaggttggggtaagggg

SEQ ID NO: 329015 - DNA, 595 bp, Homo sapiens
  misc_feature: GZ8MTXP01DXH5T.51.76.G10.1.454.CMB.2.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagagtgttagcagcgattagcctggacngcagaacngcagctccagctctcatctatgatgcatccacgaacggccactgatacnccagccgtaggttccaggtgcgtaggtcgggtctggggacaggtacgttcactctcaacactcagcacgtcctagaccgtaggttactaggtaagttatttagtaacttaatttttacttacgttaggtactaacgtactaaaggttaacttaaacgttaaaccgtcgtacccgtttaaccgtaccgttacgtttaacgggcccgttaagggggacccttaaggtacgttagggaacttacttaacgtaaacggtagtggtacggtcgttacgtcccttaacgttcg

SEQ ID NO: 329016 - DNA, 576 bp, Homo sapiens
  misc_feature: GZ8MTXP01ATRLJ.51.76.G10.1.454.CMB.2.raw
  modified_base (188)..(188): a, c, t, g, unknown or other
  misc_feature (188)..(188): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
  modified_base (468)..(468): a, c, t, g, unknown or other
  misc_feature (468)..(468): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggaggtccctgagtctctcctgtgcagcctctggacttcgaccttcagtgcctatggcatcgcacgtcgggtcccncaggcctcgaggcgaagggggctgggagtgggtgctatttanactcagatgatcgggntaagtaanaaagntatggacaggtcctcgtaggtaacgggactacttaccaaccctataccctaccgaagacgaaccctaaacttacccgaaanaaaccgactacgtntaacgtctacgactaaatcgaaatagtagtcgagaacgtacgaggaacgcgacggtcttggttcgttcttcgtggtaacgacgtaacgttgtaaggttgggtaagggg

SEQ ID NO: 329017 - DNA, 563 bp, Homo sapiens
  misc_feature: GZ8MTXP01A2XMF.51.76.G10.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctctgtncagcctntgnttcacttnagtgcctatggcatgcacgtggtcccgcaggcctacgaggcgaaggggctgggaggtgggtgactatttanatacgagtntgagtggactaaaagtaataagatagtacgactaggttaccgtacggtaggaacgggcctattccgaactactcctaccgagaacgacctaaactaccccaagaaccactacctagtactctagaactaancgaaanatagtgagtacnggtaagagaccgagttgtgtattagtttcgagtaacgacgtaagntagngggtaaggttgggtaaggg

SEQ ID NO: 329018 - DNA, 591 bp, Homo sapiens
  misc_feature: GZ8MTXP01D9ACZ.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgattagcctggtaccagcagaaacctggccaggctccaggctcctcatctatgatgcatccacaagggcccatgatactcccagccaggttcagtggcaggtgggctgggacagtagttcactctcacatcagcagcctgacagtctagaattatttgacttaattttattacttgtacagactaagttaattaacgtaaacgttcgggtacccttacccgttacttaccgttttaacgggacccgttaacggggggtaacccttaaaggtccgttaggggttaaacgttacgttaaacccgaaaacgtaacgttcgggttacggggaccttacggaacccgttaacctttaacg

SEQ ID NO: 329019 - DNA, 598 bp, Homo sapiens
  misc_feature: GZ8MTXP01A08MV.51.76.G10.1.454.CMB.2.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctgggtggagtcgtgggggagcgtggtccaggcccgggagtccctgagactctcctgtgcagcctntggattcacttcagtgcctanggcatgcacgtggcccncaggcctccgaggcgaagggggctggagtgggngactatttanatcagtanagagtggacaaaagttaaataagagtacgtgactaagtccgtcgtagaacgggtccctattccaacctnttaccacccagaacgacctaacttaccccaaagaaccaccgtaatgtaactcgtacgaacaaagtagaacgagtatagaagnggtcaaggaggaaccgtcgggttcttggttagttacgtttccgttaggttaacgaacgtaaaccgttgtaggttaggtaagggttaaggggttaaagggg

SEQ ID NO: 329020 - DNA, 704 bp, Homo sapiens
  misc_feature: GZ8MTXP01C21KZ.51.76.G10.1.454.CMB.2.raw
  modified_base (175)..(175): a, c, t, g, unknown or other
  misc_feature (175)..(175): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagcttgggttttcctcgttgcttcttttaagaggtntccaggtgtcaggtgcagcgtgggtgggaggttcggtgggggggaggtcggttcgggtcccgacgggccccggggaggtcccctggacgaccttcctccgtgtcgcacgtcctcgtggtacttccaccttcgagtcgcctagtcggcagtgccacgtcgggccccgccgagggcctaccggagggacggaagggggctggggtagggttgggggtcgtactttaatttanattacgaagtagttaggagttagggaactaaaaaggttaaaagtaaggagttatcggacgtacggtccggtacgggtaggaaacggggtcctacttaccacctactcctacgaacgaacgtaacctaactccccgaataaacctactacgttacgtactactacgaaactaaagtacgaagtaagtgttaagacgtggtacgtaagggaacggacgtacggttgtttaggtgtttacgttcggttcgtaacggaacgtaacgtagttagggttaggtaagggggttggggtttaaaggg

SEQ ID NO: 329021 - DNA, 573 bp, Homo sapiens
  misc_feature: GZ8MTXP01AYEM4.51.76.G10.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (538)..(538): a, c, t, g, unknown or other
  misc_feature (538)..(538): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtncagcctntggacttccaccttcagtcgcctatggcatgcacgtcgggccncaggctcgaggcgaagggggctgggagtgggngctatttantcgagatggatgactaaagtaataagngtangctagtcncgngaagcattcacntcaccganagaaccactaccagaacacgactgatcctagaacaaagtacgaaactaagtagttaggaacgacggtaccggtaagaaccgggaccaacgggttcgttagttaggtttactttcgttaggttccgaacgtaaccgngttaggttagggtaagggttaaggggttaaggggg

SEQ ID NO: 329022 - DNA, 632 bp, Homo sapiens
  misc_feature: GZ8MTXP01CVTLL.51.76.G10.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggcccgggagtccctgacgacctctcccgtgcagcctntggattcaccttnagtcgcctagtggcagtcgccacgtcggggtcccnccgaggcctaccgagggccgaagggggctgggggaggtcggggtgacttatttanatcaagtactggagtggactaaagtaaaaanaaagngtatgactagtcgtaccgtaggaacggctatccacatcacagacataactccgaagacactactgtactcgagacaaagtgaaacagtaagtgaaacggntaccgtaggaacggtacgaccggttagttggttaacgtttcgtttacggttggttaaccggaaaccggtaaaaccggttcgttaaaggtaggggttagggggttaacgggggttaaggggttttaaaagggggg

SEQ ID NO: 329023 - DNA, 749 bp, Homo sapiens
  misc_feature: GZ8MTXP01D2HG7.51.76.G10.1.454.CMB.2.raw
  modified_base (273)..(273): a, c, t, g, unknown or other
  misc_feature (273)..(273): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcggtgggggagcgtggtccaggcccgggagtccctgagacctctctgtgcagcctgtgacttccaccttnagtcgccttagcggcagtcgccacggtcgggtcccgaccagggtcctaccggaggaccggaaggggggtctagggggagggttgggggtacggactttaagttttaacatacgaaggtattaggagtacggaactaaaaaaggttaaaagttaaacggagtataggaccgtagttaccggtacccgggtagggaaaccggggtcctaacgtttcccaacctattacccgtaacgaacggaactaacctaaaccttaccccgaaagtaaacctaacctacggggtttaattaacttcgaacgtaaactaaaacgcgtaaaagagttaagttacggaaaggttaccgaggttaaacggaacgggttaccgacggggtttattaggttaaggttttacctttcggttagggttaacggaaaccgtaaacgtgggttaaaagttagggggtaaccgggtttaaggggggttaaaaggggg

SEQ ID NO: 329024 - DNA, 587 bp, Homo sapiens
  misc_feature: GZ8MTXP01BJ3VQ.51.76.G10.1.454.CMB.2.raw
  modified_base (169)..(169): a, c, t, g, unknown or other
  misc_feature (169)..(169): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtggtccaggcccgggagtccctgagtactctcctgtgcagtcctntggacttccacctttnagtcgcctagtggcagtcgcacgtgggtccccncaggcctccgaggcgaagggggctggaggtgggngctatttanatcgagntgagtgataaaagttaanaagngtatgatacgtcgtcgtaggaacggtcctattccgactactcgtaccgagactaccaacttcccaaagacctacgtactaggtacttacgagaaccaaagtgaaacgagttagtagaggactcggaagggacggaacgtcgttacgttgtacgtttcgtttcgacggtaagaccgtaatgtagttagggtgggttaaggggttaagggg

SEQ ID NO: 329025 - DNA, 624 bp, Homo sapiens
  misc_feature: GZ8MTXP01B18Q0.51.76.G10.1.454.CMB.2.raw
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (411)..(411): a, c, t, g, unknown or other
  misc_feature (411)..(411): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
  modified_base (613)..(613): a, c, t, g, unknown or other
  misc_feature (613)..(613): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggcccgggaggtccctgacgactctcctgtcgcagcctctggacttccaccttnagtgcctatcggcatgccacgtcgggcccnccgaggcctccggagggcgaagggggtctgggaggttgggggtgtactaatttagtacgtcgagtatgagtagggtactaaggttaaaagtaaaaggagttaancggactacggttacccgtcggtagggaacgggacctagttaccaaccgtactccgtaaccgagaacgtacctaaacttacccgaagaaccactaacgtgtaactacgtagaacctaagtacgaaactagtagtagagtaagcgttaggacggcgaacggtnttcggttnttactttccgagttcgaacgacgttagttaagngggtaaggggg

SEQ ID NO: 329026 - DNA, 685 bp, Homo sapiens
  misc_feature: GZ8MTXP01AKMN4.51.76.G10.1.454.CMB.2.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctntggacttccaccttcagtcncctagtggctagtcgcacgtcggggtcccnccgaggcctccgaggcgaagggggtctgggggaggtgggggtgacgtaattttanaacgtcgaaggtataggagttcgggaactaagtaaagtaaaagggnttacgtgacctagttcccgtaccggtaggaacgggtaccgtacttaccacctactctaccgaagaacgaactaaccttacccgaacgaaccgtaactaaccgtagtaactactacgaacctaaagtaacggaaactagtaagtttacggaaggtaaggtaacgttacgggaaacgggttacccgtaacgggtccgtttcgttggttttaacgtttccgttgggtaaccggtaacggtaaacgggttaccgttaaggttaacggggtttaaaggggg

SEQ ID NO: 329027 - DNA, 744 bp, Homo sapiens
  misc_feature: GZ8MTXP01D32C8.51.76.G10.1.454.CMB.2.raw
  modified_base (191)..(191): a, c, t, g, unknown or other
  misc_feature (191)..(191): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtncagcgtggtggagtcgtgggggagcgtggtccaggcccgggagtccctgagactctcctgtncacgtcctgtggtattccaccttnagtgcctagnggctatgctacgtgggtccccncgaggtcctacgaggacggaagggggtctgggaggtgggtgtctatttatactcgaggtataggagtcggaacgtaagggtaaaataaagggtagtaacgtcggacgttaacgggttcccgttacccgggtaagggaaaccgggtcccttaagttacccaaacccgtacgtttacccaccgaaagggtaaacccgtaaaccgtaaacctttaaccccaaaacggtaaaccctaaccgttaacgttacggttaaacctaccgttaaccggaaaccctaaaagttaacccggaaacgtaagtaaaggttaccgaagggttaaccgcggttaaagggaaccggttaaccggaacggttccgttagggttcctttagtttcccggttaaggaaccggtaacccgaaaacgttcgttaagggttaagggttaaagggggg

SEQ ID NO: 329028 - DNA, 753 bp, Homo sapiens
  misc_feature: GZ8MTXP01DV0CV.51.76.G10.1.454.CMB.2.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccgagcccgggagtccctgacgactctcctgtgcagcctctggattcaccttnagtncctatggcatgcctacgtcgggtcccnccgacggtcctccggacggacgaagggggtcgtaggggaggttgggggtcggtacttaagttttaagtacgtacgaaggtagtagggtaagtcggggtaacgtaaaaaaaggttaaaagttaaacgggtagttaagttaccggtaacgtaaccgggtttccgggttacccgggtaaagggaaacccgggggtacccttaactttaacccgaaccctaacgttacccgtaacccgaacgggtaaacgtaaaccctaaaccgttaaaccccgaaagaaacctaccgtaaccgttagttaacttccgtaagaaccaaaagttcgaaacgtaaagttagtaagtagaacggtcgtaaggacggacggtaccgttgttaggttagtttaacgttcgttagggtaaccgtaacgtaaccggtattacgggttaggtaaggggttcgggggtttaaagggg

SEQ ID NO: 329029 - DNA, 713 bp, Homo sapiens
  misc_feature: GZ8MTXP01CNE1O.51.76.G10.1.454.CMB.2.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtcctccagccaccctgtctgtgtcctccgaaggggaaancgcccaccctctcctgccgagggccagtcagtagtgtagcagcgtattagccgtggtaccagcaagaaacctggaccaggcctccgaggcctccncatctatgatgcactccgacgaacgggcccaagtgactacctcccgacgccgtaacggttccaaggggtcggacgtacggggttcggggttacgtcgggggaaactaacgggtacgttttacccaaccgttcctaccaacctacttacccgaagtcccaacggtccccgttggaacctacgggttactaggttaaaggttctttttaacggactttaaattttaacttacgttcgtacgtaacggtaacttaaagttaacttaaagttaaccgtcggttacccttaaccgttaaccgtttaccggtttcgggaacccggttaacgggggtaacccaaaggtccggtaagggacgttacttaaacccggtaaaacgtacggttggtaccgtacgttacgtaacccttaaccgttaacg

SEQ ID NO: 329030 - DNA, 771 bp, Homo sapiens
  misc_feature: GZ8MTXP01ES9S1.51.76.G10.1.454.CMB.2.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtcctccactcctccctcgcccgtcacccctggacgacgcccgcctccatcctcgtgctaggtctagtcagcgtcctcngctatagtatgatacaatntggatgcactganagaacgcgaggcagtcctaccacgtacggttctagtattacgtttagttacgtacgttaccgtaacggtcccccccccgggggtcccccggggttactacgacgtacggttcgaggtcgggacgtaggggtgtacgacgtacgggaccaaagttagttttaattaaacgtacgtaaaagtaaacgttacgaacggtacgggtaaggtagggggttacggaaccgggttaggttaaggggtacgggtttaaggggggtttttaccgggggtttttaaggggttttaactaaccggtttggttaccaaggtttaacgttaaccggtaacgtaaaccgtttaccctaaaccggtaaaaccttaaaccccggtttctttaaacccggggttacgtttaccggggtttaccgggggaacggggtttaaacggggacccgggttaaagggtccgaaaaggtttaaccccgagggttaaaaccggttcggtaaacggttcgggttccg

SEQ ID NO: 329031 - DNA, 652 bp, Homo sapiens
  misc_feature: GZ8MTXP01DN3EP.51.76.G10.1.454.CMB.2.raw
  modified_base (188)..(188): a, c, t, g, unknown or other
  misc_feature (188)..(188): n is a, c, g, or t
  modified_base (443)..(443): a, c, t, g, unknown or other
  misc_feature (443)..(443): n is a, c, g, or t
  modified_base (619)..(619): a, c, t, g, unknown or other
  misc_feature (619)..(619): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggcccgggagtccctgagactctcctgtgcagcctctgattccacttcagtgcctagtgcatgcacgtgggtcccgccgaggcctccgaggcgaagggggctagggaggtgggtcggacttatttagatcaagatcgagttggactaaaagttaaataaaggagttaagtggcctaaggttccgttaccgggtaggaaccggggtccgtaacttccaaacctnttaccctacccgaaagacgaaacctacttaccccgaaagaacctaactacgtagttactacgtacgaaacctaaatacgaaactaaggtattggaacgtaaggtctaagggacggttaacgtaccggttcgttaggtttgttaccgttttagcggtaacgtaaaccggtaaccgtntaaggagggtaaggttaagggggtttaaagggg

SEQ ID NO: 329032 - DNA, 629 bp, Homo sapiens
  misc_feature: GZ8MTXP01D7R23.51.76.G10.1.454.CMB.2.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (468)..(468): a, c, t, g, unknown or other
  misc_feature (468)..(468): n is a, c, g, or t
  modified_base (561)..(561): a, c, t, g, unknown or other
  misc_feature (561)..(561): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagnggtgtccagtgtcaggtncagctggtggagtcgtgggggagcgtggtccagcccgggagtccctgagctctcctgncngcctntgattcacttcagtcgctagngcatcgcacgtcgggtccncaggcctcgaggcgaagggggctgggaggtgggtgctatttanactcgagtatgatgggaactaaggtaaataaagacgttaagcgtacgtacgttaccgtaccggttagggaaacggtccgtacttaccaaccgtactaccgtaccgaggtaacaaactaactacccgaaanaaacgtacctagtttagtactactacgaaactaaatacgaaactaggtaattaggaagtaacgccgttagggaacggttaccgtaaccgggtnttaggtttcgtttacgtttcgtagggtaaccggtaacgaaacgttcgttaaaggttgggttaaggggg

SEQ ID NO: 329033 - DNA, 641 bp, Homo sapiens
  misc_feature: GZ8MTXP01CEJLG.51.76.G10.1.454.CMB.2.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (605)..(605): a, c, t, g, unknown or other
  misc_feature (605)..(605): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccgaggcccgggagtccctgagactctcctgtgcagcctntggattcaccttnagtcgcctagtggcagtgcacgtcggggtccccgccaggcctaccgaggacgaagggggctgggggaggttcggggtgactagttttanactcgagntggagtgggaactaaggtaaataaagggtagttaagtggaccgtaggtcccgttacccgggtaaggaacggggtccctagtttacccaaccgtactaccgtaccaaggaacgtaacctaacttaccccgaaacgaaaccgtactacgttagtactcgtaagactaaaagtacgaacgtaagtagtgaacggtaagtcgttaggaccggacgaccggtgttgttgttacgtttcgnggttaacgaacgacgttagtaaggttgggtaagggg

SEQ ID NO: 329034 - DNA, 717 bp, Homo sapiens
  misc_feature: GZ8MTXP01AGY0B.51.76.G10.1.454.CMB.2.raw
  modified_base (302)..(302): a, c, t, g, unknown or other
  misc_feature (302)..(302): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattccaccttcagtgcctatcggcatgcacgtcgggtcccnccaggcctccgaggccgaagggggctggggaggtgggtgactatttagactcagtatggatagggactaagttaaaataaaagggtcgttaagtcggtacctaaagggttcccgtacccgggttaagggaaaccggggtccccgtaatttacccgaaccctaacgttcccgtacccgaaggaaacgaaaccctaaacttacccccgaaagtaaacccgacctaaacgttcgtaaacgttctaacgaactaaaagttacggaaaactagggttaatttacgggaaaggtaagtccggttagggaaaccgggttaaaccggtaccggggtccgtttagggtttaccgtttacgttttcccgggtaggtaacgggtaacccgtaaaacggttcgttaagggttgggttaaacgggggg

SEQ ID NO: 329035 - DNA, 584 bp, Homo sapiens
  misc_feature: GZ8MTXP01E5CR7.51.76.G10.1.454.CMB.2.raw
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttnagtgcctatggcatgcacgtgggtccnccaggcctcgaggcgaaggggctggagtgggtgctatttanatcgagtgtgagtgactaaaagtaaagtaagagtatcgctagtccgtacgggtaggaacgggtaccgtattccgaactactccgtacgagaacaacaacttacccgaaagaacactacgtagtactacgacgaactaaatacgaaactagtagtgaagacgcgaaggaacggttacgacggttcgtgttagttacgtttcgagtaacgaacgtaacgtagttaggaggttaagggttaaggggtaaggg

SEQ ID NO: 329036 - DNA, 614 bp, Homo sapiens
  misc_feature: GZ8MTXP01A459N.51.76.G10.1.454.CMB.2.raw
  modified_base (241)..(241): a, c, t, g, unknown or other
  misc_feature (241)..(241): n is a, c, g, or t
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (481)..(481): a, c, t, g, unknown or other
  misc_feature (481)..(481): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctcgcccgtcaccccgtggacgacgcccggcctccatcctccgtgctaggtctagtcagacgtccctcngctagtagtattggataactaatagtttgggattggcctaccgtgacgaaggaacggccgaggggactacgtccaccctagacggtccctagtatcttaagtttgacgttcgacgtcccccccgggggccccggtcngactaggtcagtggctagtcgatcgagacactagttatttanactagaaactcaggactaggacggtgaagcgtagtagggtaggtttgggtttagggtttanagtagtcgacgtagcgtactaacgtctacctaaacgtaaccgttccgttacggtacggttaccggttcggggaacggttacgggacgttagggtcgaagtaacgtacgacggttaccgtaaggttaacggtcg

SEQ ID NO: 329037 - DNA, 560 bp, Homo sapiens
  misc_feature: GZ8MTXP01BUP09.51.76.G10.1.454.CMB.2.raw
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagcgatcgtatacacgaccggtgctcgatttagtcactcatacaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgacgacctctctgtgcagcctctgacttcacttnagtcncctatggctagtcgcacgtcgggtcccncgaggcctcgaggcgaaggggctagggaggtgggtgctatttanatcagtntagactggaacaaagttaataaggntatcgactgtcgtcgaggacgctatcacatcacgagacgtacactccaagaactacacgtctagtctacgaactaatgaactaggtatagagagtgtaacggagaccggtagttcgttaggtnttacgtttgnggtaacgaccgaagtcgtaggttagggtaagggttggggttaacgggg

SEQ ID NO: 329038 - DNA, 689 bp, Homo sapiens
  misc_feature: GZ8MTXP01BFLHF.51.76.G10.1.454.CMB.2.raw
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
  modified_base (627)..(627): a, c, t, g, unknown or other
  misc_feature (627)..(627): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggagcgtcggtccgaggcccgggagtccctgacgtctctcctgtgcacgcctgtggacttccaccttnagtcgcctagtcggcatcgcgtacgtcggggtccccnccgaggccctacccggagggaccggaagggggctagggacgggtgggtgctaatttanacgtcgagtatggtaattcgggaactaaggttaaaataaaagggtagttaagtcggacgtacgggtttcccgtacgggtaaggaaccggggtcctaaacgtttaccaaacccgtacgtttacccaaccgaaggtaaccgaaactaaacccgttacccgaaacggtaacctaacgtacgttagtactacgtacaaacgtaaagtaaacgaactagtaagttgaacggaactggttaggaacgacggtaacggtnttacggttgttacgtttcggtaggtcgaaaccgtagttacttaaggttaaggggtaaggggg

SEQ ID NO: 329039 - DNA, 700 bp, Homo sapiens
  misc_feature: GZ8MTXP01AXSXT.51.76.G10.1.454.CMB.2.raw
  modified_base (669)..(669): a, c, t, g, unknown or other
  misc_feature (669)..(669): n is a, c, g, or t
tcagcgatcgtatacacgaccggtgctcgattttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggagcgtggtccagccgggagtccctgagactctcctgtgcagcctctggattccaccttcagtcgcctagtcggctagtcgctacggttcgggtccccgccgacgggccttccgaggggtcgaacggggggtctggggacgggtggggtggacttagtttatatctagtattggagtgggaactaaaagtaaagtaagagttacgtaggtaccaaagttccgtacccgggttagggaacgggttaccgaacttaccaccgtaactaccctacccgaaagggtaaacgaaacccttaaacttaccccgaaacggaaaccctaaactaccggttaaggtttaataccctaacggtaaaccctaaaagtcggaaacctaagtattaggaagaacggttcgaagggaacgggacacgggttccgttaggttaccttagttttccgagtttcccgaagggttaacncgttaggttggtaagggttggggttaagggg

SEQ ID NO: 329040 - DNA, 609 bp, Homo sapiens
  misc_feature: GZ8MTXP01B48X1.51.76.G10.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtcncagcctntggattccaccttcagtcgcctagtggctatggcacgttgggcccnccgaggctccgagggcgaagggggctgggaggtggggtgctatttanatcaagtatgatgggactaaaagtaaataagngtatgactaggtccgtcggagaacgggcctagttaccactacgtactaccgaaggtacaaacttaacctaccccaaagtaaaccctcaaccgttagtaaccttctagaaaccaaagtcgaaataggtattggaagtacgacgtaaggaacggccgtaccgggttgtaggttgttagttcgttagtaacgacgtaacgtgtaggttgggtaagggttcggggtaaggg

SEQ ID NO: 329041 - DNA, 659 bp, Homo sapiens
  misc_feature: GZ8MTXP01ANOZJ.51.76.G10.1.454.CMB.2.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (383)..(383): a, c, t, g, unknown or other
  misc_feature (383)..(383): n is a, c, g, or t
  modified_base (463)..(463): a, c, t, g, unknown or other
  misc_feature (463)..(463): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgccgagggccagtcagagttgttagcagcgacttagcctggaccagcaagaacctggccaggcctccgaggcctcctnatctangatgcctactacccgaacgtacgggaccctacgttagactacctcccgagccgtaggttcaggtggtccgtagggtcgggtcgngggactaggtacgttctacctctaccacctatccgaagcgaacgtcctacggtaccagggttacctaggttaaacgtttnttttacggtaactttaacttttacggttacgttacggtaccgtagtaacgtagtttaaactaacgttaaccggttcggtaccccttacgttaaccttacgggttttcgggaccggttaaacggggtaccttaggtccgtaagggaacttaacgttacccgaaaggtagtcggtacggcttacgaaccttaacgtcc

SEQ ID NO: 329042 - DNA, 553 bp, Homo sapiens
  misc_feature: GZ8MTXP01CDE1I.51.76.G10.1.454.CMB.2.raw
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
tcagcgatcgtatacacgaccggtgctcgattttagtcactcatacaggggtgatcaggactcctcagttcaccttctcacaatgaggctccctgctcagctcctggggctgctaatgctctgggtctctggatccagtggggatattgtgatgactcagtcctccactcctccctcgccccgtccacccctggacgacgcccggcctccatcctcctgctaggtcctagtcagacgccctctgcaatagttataggataacgaactagttgattgacactgacagaacgccgaggcagtcctacaacgtcgtcctagtaactctttagtttgtagttacctaacggtccccccggggacccccggtctagacgtaggtcagtggataggagtnacgagcatagtattataananaangagagagagngngtgagagtaggttggttaggttatagtagtgatananatactactacaactaactacttacgtacgttacgtacggacggacggacggttaggtaaggagtaacgtagagacgtaacgttgtg

SEQ ID NO: 329043 - DNA, 740 bp, Homo sapiens
  misc_feature: GZ8MTXP01CLG3O.51.76.G10.1.454.CMB.2.raw
  modified_base (234)..(234): a, c, t, g, unknown or other
  misc_feature (234)..(234): n is a, c, g, or t
  modified_base (578)..(578): a, c, t, g, unknown or other
  misc_feature (578)..(578): n is a, c, g, or t
tcagcgatcgtatacacgaccggtgctcgatttagtcactcatacagggggtgatcaggactcctcagttcaccttctcacaatgaggctccctgctcagctcctggggctgctaatgctctgggtctctggatccagtggggatattgtgatgactcagtctccactcctccctcgcccgtcaccccgtggagacgcccggcctccatcctcctgctaggtctagtcaggacnccctccgtgactattagttatggaataactaacgttagttaggtattcggactaccgtgacgaagacgcgagggctagtcctaccacgtacggtctaggtacttgttatttggaacgttcgtaaccgggtccccccggggtcccccgggttcctaggtacgtacgggttacgagttcgggactagggtagtacgtaccgaagggtacaaacggttagtttaaacttttaaagtaaccgttaaaagaaaaacgttccgaaagggtacggtaaagggtagggtacgggaacgggtacgtagggggttaagggtttaggttttagggggttttaaccggggttttanacggtttaagtttcgacgttaagttcggtaaacctacggttactaaccttaaccggtaaactttccttagggtaaccgtttcggttacggggacggggttaaacgggttaccggagggtaacggaagtaacgtacgggaagttacggtaacgttggtaaccg

SEQ ID NO: 329044 - DNA, 696 bp, Homo sapiens
  misc_feature: GZ8MTXP01AZJ9R.51.76.G10.1.454.CMB.2.raw
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagagtgtccagtgtcaggtgcagctggtggagtcgtgggggagcgtggtccaggcccgggagtccctgacgctctcctgtgcagcctgtggtattcaccttnagtcgccctagtggcagtcgctacgtcggggtccccnccgtagggccctaccgagggaccgaagggggtctgggaggtgggtcgtctaatttacgacctgagtactagagttggataagttaaaagtaaacggngtaacgtcgacgtacgttaccgtacccggtagggtaaccgggtaccctaacttaccgaacccgtattcccaacccgaaaggtaacgaacccctaaaaccggtttacccccaaaacggtaaacccgaacccgttaaaccttggttaaccctttaccgtaaacgtaaaccgtaaacgtaacggtaaacgtagtaagttacggagtaacgcgttaggaaaccgcgtacggtacgtttgttcgtttacgtttcgagttaacggaacgtacgttacgtaaggttaagggtaagggg

SEQ ID NO: 329045 - DNA, 678 bp, Homo sapiens
  misc_feature: GZ8MTXP01CESUO.51.76.G10.1.454.CMB.2.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccggaggtccctgagctctcctgtncancctntggtacttcaccttcagtgcctatggcatgctacgtcgggtccccaccgaggtccctaccggagggaccgaaggggggtcgtaggggagggttgggggtggacttaattttataacncgtaaagtntaggaacgttaggaactaaggttaaaataaacggaggtttancggtacgtacgtccgtacggtaggaacggtacctacgtaccactactaccacgaagactaacctaaccgtacccaaacgaacctaactacgttacgtactaccgtaacgtaaacgtaaacgtaacgtaaactaagtaagtacgtaaggtaacggtaacgttacggtaacggaacggtacggtacgttacgtttacgtttacgtttaacgttacggtaacgtaacgtaacgttacgttaacggttaagggtaaggg

SEQ ID NO: 329046 - DNA, 739 bp, Homo sapiens
  misc_feature: GZ8MTXP01BQ2PH.51.76.G10.1.454.CMB.2.raw
tcagcgatcgtatacacgaccggtgctcgatttagtcactcatacaggggctggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggaggtcgtgggggagcggtggtccaggcccgggaggtccctgagctctccgtgtgcagcctgtggtattccaccttcagtcgcccttatggcagtcgaccgtacgttccgggggtccccgcccgtaagggtccccttaccccggaaagggggccggtaaacgggggggtcctttaggggggtaacgggggtttgggggtacggtactttaaagttttaaccgtagttaccgaaaggttacgtagggtaaggttaaccgggaaacgtaaagggttaaaagttaaaaggggtaccgttaaaggtcgtaccgttaacgggttcccgttacccggtaagggaaccgggtccctaacgttaccgacgtactaccgtacgaaggtacaaactaacgtaaccaaacgtaactactaacggttataccttacgacgaactaaagtagaacctagtacgtaggagaacggtcgaagggacgacgtaccggtgttagttgttactttggacgtaacgaacggtaaccgttggtaagttgggtaaggggg

SEQ ID NO: 329047 - DNA, 639 bp, Homo sapiens
  misc_feature: GZ8MTXP01ATQ4I.51.76.G10.1.454.CMB.2.raw
  modified_base (211)..(211): a, c, t, g, unknown or other
  misc_feature (211)..(211): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactcctccctgcccgtcaccccgtggagacgcccggcctccatctccngcaggtctagtcagacgcctcctgcatagtatggatacaactagttggattcggcaccgtgcaagaacgccgagggcagtcctccgaagtacggtcctgacttcttagtttgacgttcgtaacggcccccgggggtaccccccgggtctggactagggttcagggtcgactagggtggactcgagggacctaacgtagtattttaagtacttaagaaaatcgaagtcgaaggtaggtagggagtacgtaggtaagggtaggtttaggggtttaggggtttaatacgttacgttagtacgtagttacggactaaccggtaccttaacctaaaccgttaacctcccgttacgtaacggttaccgtttaccgggacgggttaaccgggttacggaacggtaaggagtaacgacgacgacgtcgttggtcgg

SEQ ID NO: 329048 - DNA, 726 bp, Homo sapiens
  misc_feature: GZ8MTXP01DAD4G.51.76.G10.1.454.CMB.2.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttctttttaaggaggtgtccagtgtcaggtgcagctggtggagtcgtgggggagcgtggtccaggcccgggagtccctgagactctcctgtgcagcctntggattcaccttnagtncctagtggcatcgctacgtcggggtccccgccgaggccctaccggagggaccgaaagggggctggggaggttggggtggacttatttatactcgaagtagtaggagttaagggaactaaggttaaaataaaaggagtactacggtacgtacgtaccgttaccggtaggaacggggtacccggtacttacctaacccgaacttaccctaccgaacgaaacgtaacctaaaccttaacccaaaccggaaaactaacccgtaacgttaacgttaacgttacgtaaccgtaaacgtaaaagtaaacgttaaacgaaacgttaagttaagggtaaggaacggtaacggttagggtaaacgggaccggtaaaccggtccgtttaggttcgtttacgttttaagtacggttaacggtaaccggtaaacgttaccggttggttaagggttaaggggg

SEQ ID NO: 329049 - DNA, 644 bp, Homo sapiens
  misc_feature: GZ8MTXP01EJFCY.51.76.G10.1.454.CMB.2.raw
  modified_base (168)..(168): a, c, t, g, unknown or other
  misc_feature (168)..(168): n is a, c, g, or t
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
  modified_base (471)..(471): a, c, t, g, unknown or other
  misc_feature (471)..(471): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttggctgagcttgggttttcctcgttgctcttttaagnggtgtccagtgtcaggtgcagctgggtggagtcgtgggggagcgtggtccagcccgggagtccctgacgactctcctgtgcagcctctggattcacttcagtgcctatggcagtcgcacgtcggtcccncaggcctaccgaggcgaagggggctgggacgtgggtgctagtttanatcgagtatgagtggaactaaaagttaaagtaacgtagtacgtcggacgtacggttaccgtacgggtacggaacggtacctaacttaccacctactacctaacgaagtaacaactaacctaccgaaanaaacctacgtacgttagtacgtacgtagtaaactaaagtacgaaacgtagtagtagaacgtacgagtaacggaacggttaccgtacgttacgtttaggttaagtttaccgtttgttacggtaacggaaacgtaacgtagttaggttagggttaagggttaaggggttaaaggg

SEQ ID NO: 329050 - DNA, 546 bp, Homo sapiens
  misc_feature: GZ8MTXP01EMBRR.51.76.G10.1.454.CMB.2.raw
  modified_base (256)..(256): a, c, t, g, unknown or other
  misc_feature (256)..(256): n is a, c, g, or t
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
  modified_base (537)..(537): a, c, t, g, unknown or other
  misc_feature (537)..(537): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtggagtcgtgggggagcggtggtccaggcccgggagtccctgagctctcctgtgcagccctntggattcaccttcagtgcctagtggcatgcacgtcgggtccgccaggctaccgaggcgaagggggcttgggagtgggggtgactattttagatcgaagtagtagatagggacaaggttaaaataaaggagtatgacagtctccgtagaaggcgattcgacatctcaganacaactaccgaagaacacactgtatctgacaaatagaaactagatgagaacgnttagaggacgtacggtnttgttgttacgtttgtaggtaacgacgaaaacggcgttaagngggtaaggg

SEQ ID NO: 329051 - DNA, 635 bp, Homo sapiens
  misc_feature: GZ8MTXP01DIUIX.51.76.G10.1.454.CMB.2.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacagggggggagaggagccccagcactagaagtcggcggtgtttccattcggtgatcagcactgaacacagaggactcaccatggagtttgggctgagcttgggttttcctcgttgcttcttttaagaggtgtccagtgtcaggtgcagctggtggaggtcgtgggggagcgtggtccaggcccgggagtccctgacgactctcctgtgcagcctctggattcacttcagtgcctagnggcatgcacgtggtcccncaggctccgaggcgaagggggctggagttggngtactagtttaantacagtatagagtaggactaaaagtaaataagatagtcgactacgtcgtacgggaggaacggtcctacttaccaacctactacctaacgaagaacgtaactaacctaacccaagaaacctacctaacgttacgtaacttaccgtaacgaaactaaagtaacgaaacgtaagtacgttagacggacgtacggtaacggaacggacgtacggttacgttggttagtttacgtttcgttaggtaacgtaaccgtaacgtcgtaggttagggtaaggggttaacggggttaaggg

SEQ ID NO: 329052 - DNA, 508 bp, Homo sapiens
  misc_feature: GZ8MTXP02GDGA0.51.76.G10.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccacctctcctgcagggccagtcagagtgttagcagcgacttagcctggtaccagcagaaacctggccaggctcccaggctcctnatctatgatgcatccacaagggccactgatactccagccaggttcagtgcagtggtctggggacagagttcactctcaccatcagcagcctgcagtctgaagtatttgactaatttattacttgtcagcagtataataactcggcctaccgtactacgttttacggaccgtaggggaccaaagcgtacggagatacgaaacgtaacgtcgtaggctcggacaccta

SEQ ID NO: 329053 - DNA, 505 bp, Homo sapiens
  misc_feature: GZ8MTXP02JM93J.51.76.G10.1.454.CMB.2.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcatggccagtcagagtgttagcagcgacttagcctggtaccagcagaaacctggccaggctcccaggctcctcatctatgatgcatccacaagggccatgatatcccagccccaggttcagtggcagtgggtctgggacagagttcactctcaccatccagcagccctgcagtctgagnttttagctaatttattactagttcagctagtataaataactggacctacgtactacgtttggcctacgggacaacgcgtaggagataacgaaacgaacgtcgnggactcgacacc

SEQ ID NO: 329054 - DNA, 498 bp, Homo sapiens
  misc_feature: GZ8MTXP02JDJ5X.51.76.G10.1.454.CMB.2.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttagcagcgacttagcctggtaccagcagaacctggccaggctcccaggcctcctcatctatgatgcatccacaaggcccatgatatcccagccaggttcagtgcaggtggtctggggacagagttcactctcacatcagcagcctgcagtctagaagtatttgactaatttattactgtcagcagtataatactcggacctacgtactacgtttcggccgtaggggaccaagctaggacgatacgaaacgactgtacggctacggcactag

SEQ ID NO: 329055 - DNA, 517 bp, Homo sapiens
  misc_feature: GZ8MTXP02J3X4C.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaacctggccaggctcccaggctcctcatctatgatgcatccacgaagggccactgatactccccagccaggttccaggtggcaggtggggtctggggacagtagttcactctcaccatcagcagccctgcgagtctgaagtatttgactaatttatactgtacagcagtataataactcggtacctccgtactacgtttcggccgaacggggaccaaagcgtaggacgactacgaaacgaacgtgtacggctcgacacctac

SEQ ID NO: 329056 - DNA, 486 bp, Homo sapiens
  misc_feature: GZ8MTXP02FTOCD.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggcccactgatatcccagccaggttcagtgcagtgggtctggggacagagttcactctcaccatcagcagcctgcagtctgaagatttgactaatttattactgtcagcagtataataactgcctcgtacactttcggctaggggaccaagctggagatacaaacgactgtaggctgcacta

SEQ ID NO: 329057 - DNA, 532 bp, Homo sapiens
  misc_feature: GZ8MTXP02JROK3.51.76.G10.1.454.CMB.2.raw
  modified_base (268)..(270): a, c, t, g, unknown or other
  misc_feature (268)..(270): n is a, c, g, or t
  modified_base (273)..(273): a, c, t, g, unknown or other
  misc_feature (273)..(273): n is a, c, g, or t
  modified_base (276)..(278): a, c, t, g, unknown or other
  misc_feature (276)..(278): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcggtggtttcgcgtaggctctttaagaggtgtccagtgtcaggtgcagctggtggagtcgtgggggagcgtgggtccaggccccggggaggtccctgagactctcctgtgcagctctgattcaccttcnnnctntgnnncncgtggcgcgcgcncgngngaggngnggnggtggtgntattatatnagangagtganagtaagtagagtatgcgngtcgtcgtaggacggacgtatacacactctacacgacgaactaactaccaacaacacactactactactacgaacaagtaagaacagtagtagagagtacgtacggacggacgacgtcgtagttacgttacgttcgtagtaacgtacgtaacgtacgtagtaggtaggtagggtaggg

SEQ ID NO: 329058 - DNA, 537 bp, Homo sapiens
  misc_feature: GZ8MTXP02JE6VW.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccgaggcctcctcatctatgatgcatccacgaacggcccactgactactccccagccaggttccagtcggctaggtggggtctgggggacaggtacgttcactctcaccatcagcacgcctgcagtctagtaagtatttgacttaaatttattactgtactagactaagtataatacgtcgtacctccgtactacgtttcggacgtacgggaaccagtacgtaggacgactacgaaacgtaacgtggtacgctacgaccacctag

SEQ ID NO: 329059 - DNA, 610 bp, Homo sapiens
  misc_feature: GZ8MTXP02GECGI.51.76.G10.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagcggtggtttcgcgtaggctctttaagaggtgtccagtgtcaggtgcagctggtggagtcgtgggggagcgtggtccagcccgggaggtccctgagactctcctgtgcagctctgtntctctcngtnctntgcntgcncgtcggtccgcgcgcgtccgacggcggagggcggtggtggtgggtggtgtattatatacgagtagtgtagtaggacgtaagtaaagtaagtaagtagtagtacgtacgtcgtcggtacgggtaacgggtaccgtacttacctacctactacctaccgacgaacgaactaactacccaacgaaaccaactactacgtacttacgtacgtaactaaagtaacgaacgtaagtaacgttagtaagagtacgtacggaacggacggtacggtacgttacgttacgttacgttacgttagtaacgtacgtaacgtacgtagtaggtaggtagggtaaggg

SEQ ID NO: 329060 - DNA, 507 bp, Homo sapiens
  misc_feature: GZ8MTXP02GCGGP.51.76.G10.1.454.CMB.2.raw
  modified_base (196)..(196): a, c, t, g, unknown or other
  misc_feature (196)..(196): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaaggccactgatancccagccaggttcagtgcaggtggtctggggacagagttcactctcacatcagcagcctgcagtctagaagtatttgactaatttattactgtcagcaagtataataactgcctacgtactacgtttcggaccgaggggtaccaaaggcgtaggaagtactacgaaacgtaactggtacggctacgacaccta

SEQ ID NO: 329061 - DNA, 491 bp, Homo sapiens
  misc_feature: GZ8MTXP02JXKFN.51.76.G10.1.454.CMB.2.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggcccactgatatccagccaggttcagtgcagtgggtctggggacagagttcactctcaccatcagcagccctgcagtctgaagtattttgactaatttattactgtcagacagtaataataactggacctccgtactactttcggctaggggaccaagctggatatacaaacgactgtagctgcaca

SEQ ID NO: 329062 - DNA, 492 bp, Homo sapiens
  misc_feature: GZ8MTXP02J1AIB.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggcctcctcatctatgatgcatccacaacgggccactgatatcccagccaggttcagtgcagtggtctggggacagagttcactctcaccatcagcagcctgcagtctagaagtatttgactaatttatactgtcagcagtataatactgcctcgtactactttcggaccgaggggaccaagcgtagagatacaaacgaacgtgtaggctcgacaca

SEQ ID NO: 329063 - DNA, 524 bp, Homo sapiens
  misc_feature: GZ8MTXP02JGW4O.51.76.G10.1.454.CMB.2.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctctgcatagtatgatacatattggatgcacctgcagagccagggcagtctccagaggtcctgatcttattgagttctaagtcccccggggcccccggggtcctgacgtggttcaggtggcaggtggatcgaggcacgagtattttanactagaaatcagcagagtggagntaggaggtagttggtttaggggttancgtagttcgngattgactagctactaactaaactccctagtacgtacgtttcggacggtaacgggaccgaagggtgaagatacgaagaccgaacgtgtcgg

SEQ ID NO: 329064 - DNA, 540 bp, Homo sapiens
  misc_feature: GZ8MTXP02I31D0.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggttcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttccagtgcagtggtctgggcagagttcactctcaccatcagcagcctagcagtctagaagtatttgactaatttattactgttcagtctagtataataactcggaccttccgtaactacgttttacggaccgtagggggaccaacggtacgtacggaagtaactacgaaaacgaaaccgttggtacggtaccgtaggacctaccgtaattccg

SEQ ID NO: 329065 - DNA, 553 bp, Homo sapiens
  misc_feature: GZ8MTXP02HJEKU.51.76.G10.1.454.CMB.2.raw
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (497)..(497): a, c, t, g, unknown or other
  misc_feature (497)..(497): n is a, c, g, or t
tcagcgatcgtatacacgaccggtgctcgatttagtcactcatacaggggggagaggagcccagcactagaagtcggcggtgtttccattcggtgatcagcattgaacacagaggactcaccatggagtttgggctgagctgggttttcctcgttgctcttttaagaggtgtccagtgtcaggtgcagctggtggagtcgtgggggaggcgtggtccagcccgggagtccctgagactctcctgtgcagcctctggattccaccttcagtgcctatggcatgcacgtcgggtcccnccaggcctccgagggccgaaggggctggggaggttggggtggctatttanatcagatgatggacaagtaaataagagttatgacagttctaccggtaggaacgggccgtattccaccatcctaccagacgaacaacttcccaagaacacactgtatctagacaaatcgaaacagattagagagcgtaggaggacacgggtnttgtacgttacttcgagtaacgtacgaaacgtctagtaggtagggttagggtaagg

SEQ ID NO: 329066 - DNA, 495 bp, Homo sapiens
  misc_feature: GZ8MTXP02I9B5T.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggcctcctcatctatgatgcatccacaagggcccactgatatccccagccaggttcagtggcagtgggtctggggacaggagttcactctcaccatcagcagcctgcagtctgaagtatttgactaatttattactgtcagacagtataatactgcctcgtactacgtttcggcagggaccaagcgtgagatacaaacgactagtacggctcgcactac

SEQ ID NO: 329067 - DNA, 590 bp, Homo sapiens
  misc_feature: GZ8MTXP02JFSZR.51.76.G10.1.454.CMB.2.raw
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccggggaggtccctgagactctcctgtgcagcctctggattcaccttcagtgcctatggcatgcacgtgggtcccnccaggctccgaggccaaggggctgggaggtggggtgctagtttatatcaggatggatgggacaaggtaaataaggngtatggacagtcctaccggtggaaacgggccgtattccacctatccctaccagacgactaacttcccaagaaaccacactagtatctagacaaagtgaaacagtattggaagtagacgtaggaacggacaaccgggtcttaggttacgttaacgtttcgtggttaacgaaccggtaaaaccgtcgttaagtacgggtagggtagggggttaaagggg

SEQ ID NO: 329068 - DNA, 540 bp, Homo sapiens
  misc_feature: GZ8MTXP02H4Q2J.51.76.G10.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctntggattcaccttcagtgcctatggcatgcacgtggggtcccncaggcctccgagggccaaggggctgggagtgggtggctatttanactgagatgatggacagtaaataaagagtangcagtctcgtagacggctatcactatcctacagacactaactccgaaanaacacatagtatcagaacaaagtacgaaactaagatagaagagacgtaggaacgaacgacggtcgtagtttagttacgttttcggcggtacgaacggtaacgtacgtagtagggtaggg

SEQ ID NO: 329069 - DNA, 649 bp, Homo sapiens
  misc_feature: GZ8MTXP02H57UK.51.76.G10.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctctttaagaggtgtccagtgtcaggtgcagctggtgagtcgtgggggaggcgtggtccaggcccgggagtccctgagctctctgtgcagccctnggattcaccttcagtgcctatggcatgcacgtcgggtcccnccaggcctccgaggcgaaggggctggggagtggggtgctagtttanactgagtatggtagtcggactaagttaaaagtaaagagttagtacgtaacgtcgtaccggtagaacgggcctacttccaacctactacctacgaagaacgaacctaacgtacccaaagaaacctactaacgttagtaactacgtagaacgaaacgtaaacgtaaacgaagtaagttagtaaggtaacggtacggtacggaacgggaaacggtaaccgggtacggttacggttacgtttacgtttacgttaacggtacggtaacggtaaacggtaacgttaacggttacgggttaaggggtaaggggg

SEQ ID NO: 329070 - DNA, 550 bp, Homo sapiens
  misc_feature: GZ8MTXP02IHWDP.51.76.G10.1.454.CMB.2.raw
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctcctgcatagtattggatacaactatttggattggcactgacagaagccagggcagtcnccanaggtcctgatctattgagttctaagtccccggggcccccgggtcctgactaggttcagtcggcaggtggatcgaggcacagtatttanactagaaaatcagcaagagtggagctaggagtagttgggtttagggttatcgtagttgctagtgacaagctacgtaactaaactccttactaacgtaccgtttacgggacgggtaacgggtaaccgtaaggggtaaggaagtaacgtacgaaaaggtaccgaaacgttagtcgg

SEQ ID NO: 329071 - DNA, 509 bp, Homo sapiens
  misc_feature: GZ8MTXP02GIVVK.51.76.G10.1.454.CMB.2.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccagggcagtctccacaggtcctgatcttatttgagttctaagtccccgggcccccgggtcctgacaggttcagtggcagtggatcaggcacagtatttanactagaaaatcagcagagtgagntgagatggttgggttatnattgnatganaagctactaacaaactcctactacgtacgtttacgggacggagggaccgaaaggtggaagagtacgaaaggacgaacgtgtagg

SEQ ID NO: 329072 - DNA, 552 bp, Homo sapiens
  misc_feature: GZ8MTXP02F20NS.51.76.G10.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggacttcaccttcagtgcctatggcatgcacgtgggtcccnccaggcctccgaggcaaggggctgggagtgggtgctatttanatcagatgatggactaagtaaataagngtatgactagtctccggtgaacggggcctattcaccatcctaccagacgaactaacttacccaagaaaccactactagtactactacgaacaaatagaaacaagtagtagagagacgtacgaggacgacggtcgtacgtacgttacttacgtgtaagtacgaacgtacgtagtaggtaggtaggtagg

SEQ ID NO: 329073 - DNA, 528 bp, Homo sapiens
  misc_feature: GZ8MTXP02H3I10.51.76.G10.1.454.CMB.2.raw
  modified_base (257)..(257): a, c, t, g, unknown or other
  misc_feature (257)..(257): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagccctntggattcaccttcagtgcctatggcatgcacgtgggtcccgccaggcctccgaggccgaaggggctgggagtggggngctatttanatcagatgatggacagtaaataaagngtatgcagtctcgtgaaggcgattcacctatcctacagacgacaattcccaagaaccacactagtatctagacaaatgaaacagtatagagacgngtggacggacacggtcgtgttagttatttcgtagtacgacgtaaacgtcttagtaggtaagggg

SEQ ID NO: 329074 - DNA, 495 bp, Homo sapiens
  misc_feature: GZ8MTXP02JQV80.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggcctcctcatctatgatgcatccacaagggcccactgatactcccagccaggttcagtgcagtgggctggggacaggacgttcactctcaccatcagcagcctgcagtctgagtatttgactaatttattactgtcagcagtataataactcgcctcgtactacttttcggcgagggaccaagcgtacggagatacaaacgacgtgtaggctcgacacta

SEQ ID NO: 329075 - DNA, 520 bp, Homo sapiens
  misc_feature: GZ8MTXP02F20UE.51.76.G10.1.454.CMB.2.raw
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtggggtcccnccagggcctccgaggccgaagggggctgggagtggggtggctatttanatcagatgatggcaagtaanagntatgcagtctcgtagacggcgattcacatctaccagagacaactacccagaaaccacactgtatctagacaaatgaaacagattgaagagctaggaggacacggtctgtagttacttcgtgtcgtacgaaacgtctagtggtaggtgggtaaggg

SEQ ID NO: 329076 - DNA, 509 bp, Homo sapiens
  misc_feature: GZ8MTXP02HW0LU.51.76.G10.1.454.CMB.2.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctntggattcaccttcagtgcctatggcatgcacgtgggtcccnccagggcctccgagggccgaaggggctagggagtggggtgctatttanatcagatgatgganagtaaatagntangcagtcncgtgagcatcacntcncaganacactccagaacacactgtatctgacaaatagaacagatgagagctagacggacacggtctagttacgttatttcgtgtgacgaaacgtctaagtggtacggtgggtaaggg

SEQ ID NO: 329077 - DNA, 500 bp, Homo sapiens
  misc_feature: GZ8MTXP02JZRIK.51.76.G10.1.454.CMB.2.raw
  modified_base (290)..(290): a, c, t, g, unknown or other
  misc_feature (290)..(290): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (468)..(468): a, c, t, g, unknown or other
  misc_feature (468)..(468): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcactgggtccnccaggctccaggcaaggggctggagtgggtgcatttanatcagatgatggcagtaataagngtatgcagtctcgngaagggccagttcaccatctccagagacaattccccaagaacacaactgtatctagacaaatagaacagattagagagcagaggacgaacggctgtgtacttntgttgcgaacggactagtagagtggtaagggg

SEQ ID NO: 329078 - DNA, 574 bp, Homo sapiens
  misc_feature: GZ8MTXP02HLRLY.51.76.G10.1.454.CMB.2.raw
  modified_base (258)..(258): a, c, t, g, unknown or other
  misc_feature (258)..(258): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctntggattcaccttcagtgcctatggcatgcacgtcgggtccgccaggcctaccgagggcgaagggggcttaggggaggtggggtgctatttacatcgagatgatggactagtaaataaaggagtagtgacagttcccgtacgtaggaaacgggtccgaattccgaacctactcctaccgaagacgaactaacttacccaaagaaaccactaactgtaactctagaactaaatagaaacagtaagttagaagtagcgtaggaacgacgacggtcgtgttgttatttcgtagtacgacgaacgtactaggtagtagggg

SEQ ID NO: 329079 - DNA, 550 bp, Homo sapiens
  misc_feature: GZ8MTXP02JYN73.51.76.G10.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctnatctatgatgcatccacgaacgggccactgatactcccagccaggttcagtgcaggtggtctggggacagtacgttcactctcacatcagcagcctgcagtcgtagtaagtatttgactaattttattactgtacagtactaagtaataagtaacgtcggtacccttaccgtactacgttttacggaccgtaacggggacctaaacggtcgtacggacgtacttaaccgaaacggtaacgtacggtacggacgtcgacgtacctacg

SEQ ID NO: 329080 - DNA, 560 bp, Homo sapiens
  misc_feature: GZ8MTXP02HCJPY.51.76.G10.1.454.CMB.2.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
  modified_base (497)..(497): a, c, t, g, unknown or other
  misc_feature (497)..(497): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcccgggaggtccctgagactctcctgtgcagcctctggattcaccttcagtgcctatggcatgcacgtcgggtcccnccaggcctccgaggcgaaggggctgggaggtgggtgctatttanatcagtatgatggacaagtaaatagatangactagtctcggtaggacggctatcacatccacagacaactaactacccaagaaaccactactagtactcgtagaactaaagtacgaaacagtagtagaagagtacgtaggaacggacgacggtnttaggttacgttactttcgtagtaacgaacgtaaacgtcgtagtaggtacgggtaggggtagg

SEQ ID NO: 329081 - DNA, 499 bp, Homo sapiens
  misc_feature: GZ8MTXP02JMG1D.51.76.G10.1.454.CMB.2.raw
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctcctgtgcagcctctggattcaccttcagtgcctatggcatgcacgtgggtccgccaggctccaggcaaggggctgggagtgggtgctatttanatcagatgatggcagtaaataaagngtatgcagtcncgtgaggcgatcacatctcagagacaattacccagaaacacactgtactntagacaaatgaaacagattgagacgagtagaggacacggcgtagtgttattcgngtacgacgaacgctagngtagg

SEQ ID NO: 329082 - DNA, 517 bp, Homo sapiens
  misc_feature: GZ8MTXP02IQCDW.51.76.G10.1.454.CMB.2.raw
  modified_base (196)..(196): a, c, t, g, unknown or other
  misc_feature (196)..(196): n is a, c, g, or t
  modified_base (339)..(339): a, c, t, g, unknown or other
  misc_feature (339)..(339): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacaaggcccatgatatcccagccaggtcagtgcagtggntcgtgggacagagttccatctcaccatcagcagccctagcagtctagaagtattttgacttaatttatttactgttacagactagtaataaactaactgaccttacgacttacgtttcggacctaggggaccaaggtcgtaggacgataacgaaacgactaggtcgactcgactaacg

SEQ ID NO: 329083 - DNA, 510 bp, Homo sapiens
  misc_feature: GZ8MTXP02J1K2N.51.76.G10.1.454.CMB.2.raw
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtgggtccaggccccgggaggtccctgagactctcctgtgcagcctctggattcaccttcagtgcctatggcatgcacgtgggtccgccaggcctccgaggcaaggggctgggagtggggtgctatttantcagatgatggcagtaatagngtatgcagtctcgtgaaggccatcacatctcagacgacaattcccagaacacactgtatctagacaaatgaaacagtattagagtagctggaggacgacggtctgtagttatttcgtgtgacgaaacgctagtggtaaggtgggtaaggg

SEQ ID NO: 329084 - DNA, 518 bp, Homo sapiens
  misc_feature: GZ8MTXP02GYBIN.51.76.G10.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggattcaccttcagtgcctatggcatgcacgtgggtcccnccagggcctccgaggcaaggggctgggagtgggtgctatttanatcagatgatggacaagtaaatagngtactgcagtctcgtagaacgggccattcacatctcaganacaatcccaagaaaccacatgtatctagacaaatgaaacagatgaagagacgtagaggacacggctagtacgtattctagtcgacgtaaacgctaagtggtaggtagggtaaggg

SEQ ID NO: 329085 - DNA, 513 bp, Homo sapiens
  misc_feature: GZ8MTXP02IS3PW.51.76.G10.1.454.CMB.2.raw
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagcccgggaggtccctgagactctcctgtgcagcctctggattcaccttcagtgcctatggcatgcactgggtccnccaggctccgaggcaaggggctgggagtgggtgcatttanatcagatgatggcagtaatagngtatgcagtctcggtgaaggcattcacatctcagagacaatcccagaacacactgtatctgacaaatgaaacagaattgaagagctagagacacgggtctggtcgttaatttcgtgttaagaccgtaaaacgcttagtaggtacggtaggggtaaggg

SEQ ID NO: 329086 - DNA, 552 bp, Homo sapiens
  misc_feature: GZ8MTXP02GZMMC.51.76.G10.1.454.CMB.2.raw
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctntggattcaccttcagtgcctatggcatgcacgtggggtcccnccagggcctccgagggcaaggggctgggagtggggtggctatttanatcagatgatggacaagtaataagngtatgcagtctcgtgaaggcatcacatctccagacacaactcccaagaaacacactgtaatctagacaaaatgaaacaagattgaagagcgtaggaggacgacggcgttaggtacgttaatttccgtaggttaacggaacgaaaacggtccttaaaggtacggtaggttacgggggttaaaggggg

SEQ ID NO: 329087 - DNA, 490 bp, Homo sapiens
  misc_feature: GZ8MTXP02H9YRB.51.76.G10.1.454.CMB.2.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagagtgttagcagcgacttagcctggtaccagcagaaacctggccaggctcccaggctcctcatctatgatgcatccanaagggccactgatancccagccaggtcagtgcagtggtctggggacagagttcactctcaccatcagcagcctgcagtctgaagtatttgactaatttattacttgtcagcagtataatactgcctcgtactactttggacgtaggggacctaaggctaggagatacaaacgactgtaggctgacaccta

SEQ ID NO: 329088 - DNA, 516 bp, Homo sapiens
  misc_feature: GZ8MTXP02HFZL5.51.76.G10.1.454.CMB.2.raw
  modified_base (403)..(403): a, c, t, g, unknown or other
  misc_feature (403)..(403): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcctgcatagtattggatacaactattggattggcacctgcagaagccagggcagtctccacaggtcctgatctatttgagttctaagtccccggggcccccggggtcctgacaggttcagtggcagtggatcgaggcacagtattttaatactagaaaatcagcagagtggaggntaggaggtagttggtttagggttatgtagtgcatgacagtctactaactaactctactacgtacgttacggacggacggacgaggtaagagacgtacgagacgtacgtggtcg

SEQ ID NO: 329089 - DNA, 519 bp, Homo sapiens
  misc_feature: GZ8MTXP02FXBDU.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggcctcctcatctatgatgcatccacaagggcccactgatactcccagccaggttcagtggcagtgggtctggggacagagttcactctcacatcagcagcctgcagtctagtaagtatttagactaaatttattactgttacagtactagtaataataactcggtaccttaccgtactacgtttcggaccgtaggggaccaagctaggactatacaaacgtactggtacgctcgactactac

SEQ ID NO: 329090 - DNA, 541 bp, Homo sapiens
  misc_feature: GZ8MTXP02IV6BU.51.76.G10.1.454.CMB.2.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccacctctcctgcagggccagtcagagtgttagcagcgacttagcctggtaccagcagaacctggccaggctcccaggcctcctcatctangatgcatccacaagggcccatgactatcccagccaggttcagtggcaggtggtctggggacagagttcactctcacatcagcagcctgcagtctgaagtatttgactaaattttattacttgttcagtctaagttataataacgtcggcccttaccgtactaacgttttcggaccgtacgggggacccaaaggcgttacgggaacgtattaacgaaaacgtaaacgttcggtagggacctggacctaccgtacg

SEQ ID NO: 329091 - DNA, 494 bp, Homo sapiens
  misc_feature: GZ8MTXP02JKHP0.51.76.G10.1.454.CMB.2.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccggggagtccctgagactctcctgtgcagcctctggattcaccttcagtgcctatggcatgcactgggtccnccaggctccaggcaaggggctgggagtgggtgctatttanatcagatgatggcagtaanaaagagtatgcagtctcgtgaggcgatcacatctcagagacatacccagaacacactgtactctgacaatgaacagatgagagctaggacgacgacggctgtagtatttcgtggtacgacgaacgtctaagtgtaggg

SEQ ID NO: 329092 - DNA, 496 bp, Homo sapiens
  misc_feature: GZ8MTXP02GNJ3O.51.76.G10.1.454.CMB.2.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcagaaacctggccaggctcccaggctcctnatctatgatgcatccacaaggccactgatactcccagccaggttcagtggcagtgggtctggggacaggagttcacgtctccaccatcagcacgccctgcagtctagaagtatttgacttaatttattactgtcagctagtaataatactggcctcgtactactttcgccgtagggaccagctggacgatacaaacgactagtggctgcactac

SEQ ID NO: 329093 - DNA, 660 bp, Homo sapiens
  misc_feature: GZ8MTXP02JPA59.51.76.G10.1.454.CMB.2.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctcgtggattccaccttcagtcgcctagtggcatgaccacgtcgggtcccnccaggcctccgaggcgaagggggctggggagttggggtagctaagtttttaanacgtcgaagtagtggagttgggactaaggttaaaataaaaggtacgttatggacgtacggttcccgtacggtagggaacgggaccgtacttaccaacctactccgtaccgaagaacgaacctaacttacccgaaagaaaccacgtacgttagtactacgtagaaactaaacgtaacgaaacgtaagtaagttaggaagtacggtacgtacggaaacggtaccgtacgggtcgttacggttacgtttaacgtttcgtacggttaacggtaaccgtaaacgtacgttaacggttacgggtaacggg

SEQ ID NO: 329094 - DNA, 500 bp, Homo sapiens
  misc_feature: GZ8MTXP02IFRZQ.51.76.G10.1.454.CMB.2.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatancccagccagttcagtgcagtggctgggacagagttcatctacaccatcagcagctgcagtctagagtattttgactaatttattacttgtctagcagtataataactggacctacgtactacttttcggaccgtaggggaaccaaagctacggagaatacaaacgaactgtaggctcgacacac

SEQ ID NO: 329095 - DNA, 558 bp, Homo sapiens
  misc_feature: GZ8MTXP02H1NHA.51.76.G10.1.454.CMB.2.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctcncctgcagggccagtcagagtgttagcagcgacttagcctggtaccagcagaacctggccaggctcccaggctcctnatcatgatgcatccaagaacggccactgatactcccagccaggtcagtgcagtggctgggacagacgttcactcncaccatcagcacgcctgactagtctagaagtntttagacttaattttattaacgttgtactagtataagttaataaattaacgttcggtacccttaccgttaactaacgttttcgggaccgtacgggggtaaaccaacggtaccgtacgggaacgtacgtaacgaaaacgtaacgtaggtacggctacggacctactacg

SEQ ID NO: 329096 - DNA, 500 bp, Homo sapiens
  misc_feature: GZ8MTXP02JZ363.51.76.G10.1.454.CMB.2.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccanaagggccactgatatcccagccaggttcagtgcagtgggtctggggacaggagttcactctacaccatcagcagccctgcagtctgaagtattttgactaatttatactgtcagtcagtataataactggtcctcgtactacgtttcggccaggggaccaagcgtacggagagtacaaacgaactgtcggctcgcactac

SEQ ID NO: 329097 - DNA, 554 bp, Homo sapiens
  misc_feature: GZ8MTXP02I1ADY.51.76.G10.1.454.CMB.2.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctcgtggattcaccttcagtgcctatggcatgcacgtgggtcccnccaggcctccgaggcgaaggggctgggagtggggtgctagtttanatcagatgatggacagtaaataaagagtatgacagtctccgtgaacggccgattcaccatcctaccagagacaacttacccaagaacacactgtatctagacaaatcgaaacagtaattgaacgtaagctaggaacggaccgaacggtcgttaggttcgttaagtttcgtaggttacgaacggtaaaaccggttacgtaggtagggtaaggg

SEQ ID NO: 329098 - DNA, 507 bp, Homo sapiens
  misc_feature: GZ8MTXP02H9Q9F.51.76.G10.1.454.CMB.2.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (473)..(473): a, c, t, g, unknown or other
  misc_feature (473)..(473): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattcaccttcagtgcctatggcatgcactgggtccgccaggctccgaggcgaaggggctggagtggggtggctatttanatcagatgatggcagtaataagngtatgctagtctcgtgaagggccgattcactanctacagagacaacttccaagaacacactagtactntgacaatagaacagattagagtagctgaagcgacgctgtagtatttcgngtgacgaaacgtctagtggtaaggtgggtaaggg

SEQ ID NO: 329099 - DNA, 567 bp, Homo sapiens
  misc_feature: GZ8MTXP02GGX4G.51.76.G10.1.454.CMB.2.raw
  modified_base (259)..(259): a, c, t, g, unknown or other
  misc_feature (259)..(259): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacaggggctgggagaggagcccagcactagaagtcggcggtgtttccattcggtgatcggcactgaacacagaggactcaccatggagtttgggctgagctgggttttcctcgttgctcttttaagaggtgtccagtgtcaggtgcagctggtggagtcgtgggggaggcgtggtccagcccggggaggtccctgagctctcctgtgcagccctcnggattcaccttcagtgcctatggcatgcacgtgggtcccgccaggcctccgaggcaagggggctgggaggtggggtggctatttatatccagatgatggcaagtaataaagagtatgcagttcnccgtgaagggccgattcaccatcctccagacgacaaatcccaagaaccaacactagtactcgtagacctaaaagtgaaaccaggtaattaggaagagtacgtagaacgggaccgaacggtcgtgttacgttatttcgtaaggtacgaccggtaaaacgtccgttaagtaggtacggttaggggg

SEQ ID NO: 329100 - DNA, 576 bp, Homo sapiens
  misc_feature: GZ8MTXP02GRLKD.51.76.G10.1.454.CMB.2.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (272)..(273): a, c, t, g, unknown or other
  misc_feature (272)..(273): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcggtggtttcgcgtaggctctttaagaggtgtcagtgtcaggtgcagctggtggagtcgtgggggaggcgtggtcgagccgggnggtcccgtgagctctcctgtgcncgctcgtgtctctctcngtgctgtgnntcgctcgtcggcgcgcgcgcgacggaggaggngtggtggtggtggtgtattatagtagagtagtagtagtaggtagtaaagtaaagtagtaagtagtagtacgtacgtcgtacggtacggtaacggtaccgtacgtactactactctacgacgaacgaactaactaccaactaacactactatatacgtacgtaacaacgtagtaagtagtagtagagacgtacgtacggtacgacgtacgtagtacgttacgttacgttcgtacgtaacgtacgtaacgtacgtagtaggtaggtaggtagg

SEQ ID NO: 329101 - DNA, 627 bp, Homo sapiens
  misc_feature: GZ8MTXP02GYC56.51.76.G10.1.454.CMB.2.raw
  modified_base (353)..(353): a, c, t, g, unknown or other
  misc_feature (353)..(353): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggagtccctgagactctcctgtgcagcctctggattcgccttcagtcgcctatggcagtgcacgtcggggtccgccaggcctcccgagggccgaagggggcctggggagtggggtggctagttttanacgtcagtagtgagtcggactagttaaagtaaaggtagttactgtacgtacgttccgtacgggtaggaaaccggggtcccgtaattcccaaccctactaccctaccgaaagaaccgaacctaaaccttacccgaacgtaaaccacctacgttagtactaccgagaacaaagtacgaaacagtataggagacgtacgtaggaacggacgtacggtcgttacggttagttactttcgtacggtacggaacgtaaacgtcgttaggtacggtaaggg

SEQ ID NO: 329102 - DNA, 544 bp, Homo sapiens
  misc_feature: GZ8MTXP02IP0EV.51.76.G10.1.454.CMB.2.raw
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagacgcctcctgcatagtatggatacatattggatgcactgcagagccagggcagtctccacaggtcctgatctatttgattctaacgtccccgggcccccgggtcctgacaggttcagtggcagtgatcgagcacagtatttanactagaaaatcgaagtcaagaggtagggagctaggaggtagttagggtttggggtttaacngtaagtttggctaagtggacagtctactaacctaaaactccttactacggttacgtttcggggacggtaacgggacctaagggtgaacgtattacgaaaggcgtaaacgtggtacgg

SEQ ID NO: 329103 - DNA, 502 bp, Homo sapiens
  misc_feature: GZ8MTXP02I8CYB.51.76.G10.1.454.CMB.2.raw
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccgggaggtccctgagactctcctgtgcagcctctggattcaccttcagtgcctatggcatgcacgtgggtcccnccaggcctccgaggcaaggggctggagtggggtgcatttanatcagtatgatggcaagtaanagntangcagtctcgtagaacggcatcacatcacagagacatccagaacacactgtatctagacaatcgaanagattgagagctagaggacacggactgtagtacttcgtagtgacgaaacgtctagtgaggtgggtaaggg

SEQ ID NO: 329104 - DNA, 628 bp, Homo sapiens
  misc_feature: GZ8MTXP02GV6BY.51.76.G10.1.454.CMB.2.raw
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgngctctctgncngcctgtggtacttcaccttcagtcgcctagtcggctagtcgacctacggtcgggtccccgaccgaggtccctaccggagggacggaagggggtctaggggagggttggggtcgactaagtttttaanacgtacgagtagtagagtaggaactaagtaaaagtaaaggtacgtagtacgacgtacggttccgtacggtagggaaccggtacctactacccactactcctacgaacgaacaacctaaccgtaaccaaataaaccactacgtatactacgacgaaactaaagtacgaaactagtagtagagtacgtacgtaggaacgacgtacggtcgtagttagttagttcgtagtacgtaacgtaacgtgtaggtaggtaggg

SEQ ID NO: 329105 - DNA, 560 bp, Homo sapiens
  misc_feature: GZ8MTXP02G570N.51.76.G10.1.454.CMB.2.raw
  modified_base (197)..(197): a, c, t, g, unknown or other
  misc_feature (197)..(197): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggcctcctcatctatgatgcatccaacgaagggcccactgatactccccagccaggttcaggtggcaggtcgggtctgggggacaggtacgttccactctacaccatcagcacgcctgctagtctagtaagtntttagacttaattttatacttgtactagactagttaataagtaactcggtaccttacgtacttacgtttcggaccgtaggggaacccaaggtacgtagggaacgtaacgtaaccgaaaacgtacgtaggtacggactacgacctaactacg

SEQ ID NO: 329106 - DNA, 568 bp, Homo sapiens
  misc_feature: GZ8MTXP02JLCAL.51.76.G10.1.454.CMB.2.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctnatctatgatgcatccanaacgggccactgatactcccagccaggttcagtggcaggtgggtctggggacaggtagttcactctcacatcagcagcctgcagtctagaatatttgactatttatactgtacagtacagttaataactaacgtcggtacccttaccgtactacgtttttacgggacccgtaagggggtaccctaaagggtccgttagggtaaacttaacttaaccgaaaaaccggtaaccgttaggggttacggccttacggacctacccgtttaacg

SEQ ID NO: 329107 - DNA, 526 bp, Homo sapiens
  misc_feature: GZ8MTXP02H6YA0.51.76.G10.1.454.CMB.2.raw
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtctgggggaggcgtggtccaggcccggggaggtccctgagactctcctgtgcagcctctggattccaccttcagtgcctatggcatgcacgtcggggtcccnccagggcctccgagggcgaaggggctgggaggtggggtggctatttanatcagatgatggcaagtaatagatatgcagtcncgtgacggcattcaccanctccagacgacaacttcccaagaccacactgtatctagacaaatgaaacagattagagagctaggaggacacggtctagtagttactttgnggtcgacgaaacgtcttagnggtaggttaggggtaaggg

SEQ ID NO: 329108 - DNA, 738 bp, Homo sapiens
  misc_feature: GZ8MTXP02HROXP.51.76.G10.1.454.CMB.2.raw
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccccggggaggtccctgagactctcctgtgcagccctcgtggattccaccttcagtcgcctagtggcatgcacgtcggggtccnccagggcctccgaggcgaaggggctggagtggggngctatttanatcagatgatgggactaaggttaaataaggagttaaactgaccgtaagttccgtaccgggtagggaaacgggggtccctaaagtttcccaaacctattccctacccgaagtaacgaaacctaaacctttcccccgaaagaaaccaaaccctaacgtttaaggttaaacttcctaagggaacctaaaaagttacgaaaaaccgaagttaaacgttaggaaacggtaaggacccggttaagggaaaccgggtaaacccgaacccggggttacgtttcgggtttaaacggtttactttttttaccggacgggtttaaggaaaacccgggaaaaacccgtttcgttaaaacggttcggggttaaaacgggggtttcgggggtttaaaaggggg

SEQ ID NO: 329109 - DNA, 514 bp, Homo sapiens
  misc_feature: GZ8MTXP02GCNTD.51.76.G10.1.454.CMB.2.raw
  modified_base (365)..(365): a, c, t, g, unknown or other
  misc_feature (365)..(365): n is a, c, g, or t
  modified_base (468)..(468): a, c, t, g, unknown or other
  misc_feature (468)..(468): n is a, c, g, or t
  modified_base (496)..(496): a, c, t, g, unknown or other
  misc_feature (496)..(496): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcacgtgggtcccgccaggcctccgaggcaaggggctgggagtggggtggctatttatatcagatgatggacaagtaataagngtatgcagtctcgtagaacgggcatcacatctcagacgacaactaccagaacacactgtatctagacaaatcgaacagtatgagtagctaggacggacacggntagtgttacttctgtaagacgaaacgtntagtaggaggtaggtagg

SEQ ID NO: 329110 - DNA, 560 bp, Homo sapiens
  misc_feature: GZ8MTXP02GOUH2.51.76.G10.1.454.CMB.2.raw
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctntggattcaccttcagtgcctatggcatgcacgtggggtcccnccagggcctccgagggcgaaggggctgggaggtgggtggctatttanatcagatgatggacaagtaaataagatangacagtctcgtagaacggccatcacatctcagagacaactacccaagaaccacactgtatctagacaaaatagaaactagtagttagaagtagacgtaggacggaccgacggtacttcggttagttacgtttcgtaggtaacggtaaccggaaaacgtcgtagtagggtaggggttaggggtaaaggggg

SEQ ID NO: 329111 - DNA, 509 bp, Homo sapiens
  misc_feature: GZ8MTXP02GPB0R.51.76.G10.1.454.CMB.2.raw
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtccgccaggcctccaggcaaggggctgggagtggggtgcagtttaatcagntgatggcagtaaataaagngtatgcagtctcgtgaagggccatcacatcncaganacaatcccaagaaacacactgtatctagacaaatgaaacagatgaagacgcgtagacggacgacggtctgtgttattcgtaggtacgacgaaaaccgtctagtaggtagg

SEQ ID NO: 329112 - DNA, 497 bp, Homo sapiens
  misc_feature: GZ8MTXP02HX0WU.51.76.G10.1.454.CMB.2.raw
  modified_base (331)..(331): a, c, t, g, unknown or other
  misc_feature (331)..(331): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccaggcccgggaggtccctgagactctcctgtgcagcctctggattcaccttcagtgcctatggcatgcactgggtccgccaggctccaggcaaggggctggagtgggtggcatttanatcagatgatggcagtaatagagtatgcagtctccgtgaaggcgatcacatctacagagacaattccagaacacactgtatctgacaaatgaacagattagagagactgaggacacggctgtagttatttctgttcgacgaaacgctataggtaggtgggtaaggg

SEQ ID NO: 329113 - DNA, 524 bp, Homo sapiens
  misc_feature: GZ8MTXP02JXKG3.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaaacctggccaggctcccaggctcctcatctatgatgcatccacaagggccactgatatccccagccagggttcaggtggcaggtgggtctggggacagagttcactctcaccatcagcagcctgcagtctagaagtattttgactaatttattacttgtacagctagtataataacgtggtcctaccgtactacgttttcggaccgtaggggacccaggcgtaggacgaactacgaaacgacgtaggtacggactcggacacctag

SEQ ID NO: 329114 - DNA, 502 bp, Homo sapiens
  misc_feature: GZ8MTXP02IY5YX.51.76.G10.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctntcctgcagggccagtcagagtgttagcagcgacttagcctggtaccagcagaacctggccaggctcccaggcctcctcatctatgatgcatccacaagggcccactgactatcccagccaggttcagtggcaggtggtctggggacngtagttcactctcacatcagcagcctgcagtctgaagtatttgactaatttattactgtcagctagtataataactcggccttacgtactacgtttcggccgtaggggaccaagcgtaggagatacaaacgactagtcgactcgacaccta

SEQ ID NO: 329115 - DNA, 543 bp, Homo sapiens
  misc_feature: GZ8MTXP02JWOCG.51.76.G10.1.454.CMB.2.raw
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctcctgtgcagcctctggattcaccttcagtgcctatggcatgcacgtgggtccgccaggcctcgaggcgaaggggctgggagtgggtgctagtttanacgtcagtntgatggacagtaaanaaagagtangcagtcgtcgngtaacggcgattcaccatctaccagtacgactaacttacccaagtaaaccacgtactgtactcgagtacaaatacgaaacagtagtagaagacgtcgaggaacggacgaccggtcgtagttagttctttgtagtcgacgaaacgtcttaaggaggtagg

SEQ ID NO: 329116 - DNA, 506 bp, Homo sapiens
  misc_feature: GZ8MTXP02FURYR.51.76.G10.1.454.CMB.2.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctangatgcatccacaaggccactgatactccagccaggttcagtgcagtggtctgggacagagttcactcncacatcagcagctgcagtctgaagtatttgactaaatttattactgtacagctaagtataatacgtcggtcctaccgtactacgtttacggcgtaggggaccaagcgtaggacgatacgaaacgtaacgtgtacgcgtacgccactac

SEQ ID NO: 329117 - DNA, 532 bp, Homo sapiens
  misc_feature: GZ8MTXP02G6GJX.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagctacttagcctggtaccagcagaacctggccaggctcccaggctcctcatctatgatgcatccacgaagggcccatgactatcccagccaggttcagtggcaggtggtctggggacagagttcactctcaccatcagcagcctgcagtctagtaagtatttgtactaatttattacttgtctagactagtaataataacgtcggtaccttccgtactacgttttcggaccgtacggggaaccaacgtcgtaggacgaacgtacgaaacgtacgtaggtacggacgtacgaccactac

SEQ ID NO: 329118 - DNA, 549 bp, Homo sapiens
  misc_feature: GZ8MTXP02JNU4H.51.76.G10.1.454.CMB.2.raw
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggccccgggaggtccctgagactctcctgtgcagccctntggattcaccttcagtgcctatggcatgccacgtcgggtccnccaggcctccgaggcgaaggggctgggaggtggggtgctatttanactcagtatgatggctagtaaataaagngtatgacagtcgtcgtgaacggccgattcacatcctacagacgacaacttaccaagaaccacactagtatactagacaatacgaacagtagtagagagacgtaggacggacgaccgggtcgttacgttacgttacgttcgtgtacgaacgtaacgtcgtaaggtacggtaaggg

SEQ ID NO: 329119 - DNA, 542 bp, Homo sapiens
  misc_feature: GZ8MTXP02HLVC0.51.76.G10.1.454.CMB.2.raw
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcctgcatagtatggatacactattgattggcactgcagaagccagggcagtctccacaggtcctgatcgtatttgagttctaagtccccggggaccccccgggtcctgaccgtaggttcagtgggcagtggactcgaggcacagtatttanactagaaaatcaagcagaggtgaggntaggaggtattgggtttaggggtttaatcgtagttgctaagtgacaagtctactaactaaaacttcctacgtaacgtacgtttcgggacggtacgggacctaaggggtggagtactacgaagtacgaacgttgacgg

SEQ ID NO: 329120 - DNA, 571 bp, Homo sapiens
  misc_feature: GZ8MTXP02I9KXN.51.76.G10.1.454.CMB.2.raw
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccggggaggtccctgagactctcctgtgcagcctctggattcaccttcagtgcctatggcatcgcacgtggggtcccnccagggcctccgagggcgaagggggctgggaggttggggtggctaattttanatcgagtatgatgggactaagtaaataagntatgcgtagtctccggtaggaacgggccgtatccactatcctacagacgactactaccagaaaccactactagtactcgtagaactaaatagaaacgagtagttagagacgcgtaggacggacgacggtcttaggtgttactttcgtagtcgaaccgtaaagtctaggtaggtagggttaggggttaaggg

SEQ ID NO: 329121 - DNA, 540 bp, Homo sapiens
  misc_feature: GZ8MTXP02JPLPX.51.76.G10.1.454.CMB.2.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctctgcatagtattggatacaactattggattggcacctgcagaagccagggcagtctccanaggtcctgatctatttgagttctaagtccccggggcccccggtcctgactggtcagtggcagtgatcgagcanagtatttanactagaaatcagcaagagtggagctaggagtagtggtttttttggggatagtattagctaagtgacaacgtctactaactaaacctccttactacgtaccgttacggacgggtaacggaaccgtaagggtaacggaagtaacgtacgaaggaccgtaaacgtggtacgg

SEQ ID NO: 329122 - DNA, 532 bp, Homo sapiens
  misc_feature: GZ8MTXP02GZ4K3.51.76.G10.1.454.CMB.2.raw
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtccgccaggctccgaggcgaaggggctgggagtgggtgctatttanatcagtatgatggacagtaaataaagngtatgcagtctcgtgaggcatcacatcncaganacactaccagaacacactgtatnagacaaatgaaacagtattagaagacgacgtaggaacggacgacgggtactcgttagtttaagtttccgtaggttacgaaccggtaaacgtaccgttagtagggtaagggg

SEQ ID NO: 329123 - DNA, 538 bp, Homo sapiens
  misc_feature: GZ8MTXP02IGZP6.51.76.G10.1.454.CMB.2.raw
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggcccgggaggtccctgagactctcctgtgcagcctctggattcacttcagtgcctatggcatgcacgtggggtcccgccagggcctcccgagggccgaagggggctgggaggtggggtgctatttanatcagatgatggcagtaatagngtatgcagtctcgtagacggcatcacatcncaganacactccagaacacactgtactctagacaaatagaacagtattagagagctaggacggacgacggtactgttacgttatttcgtagttaacgaccggtaaaacgtcgtaagtcggtaaggttagggggtaaggg

SEQ ID NO: 329124 - DNA, 673 bp, Homo sapiens
  misc_feature: GZ8MTXP02H08XR.51.76.G10.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagtactctctgtgcagcctntgattcaccttcagtgcctagtggcatcgcacgtgggtcccncaggtcctccgagggtccgaaggggtctgggacgtggggtagactagttttanatcgaagtattgagttagggactaaaggttaaaataagggagttatcggacctaaggttccctaccgggtaggaacggggtaccctacgttaccaacctacgtcccgtaccgaacggaacgtaaacctaaaacccttacccgaaacgtaaacctaccgtaaccgttacggttactacccgttagaaacctaaagtaccgaaacgtagtaattaggacgagtacgtaggacggtaaccgtacggtacgttaggtttacgttagttttacgaggtaacggacgtaaaaccgtcgttaagtacgggtacgggttagggttaagggg

SEQ ID NO: 329125 - DNA, 686 bp, Homo sapiens
  misc_feature: GZ8MTXP02I240L.51.76.G10.1.454.CMB.2.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctctttagaggtgtccgagtggtcagggtgcagcgtggtggagtcgtgggggagcgtggtccaggcccgggaggtccctgagactctcctgtgcagccctntggattcaccttnagtcgcctagtcggcagtcgccgtacgtcgggtcccgaccgacggtccctaccggagggaccggaacggggtccgtaggggtagggttcggggtacggtacgttaaagttttagtaaccgtacgtaagtagtaggtaggtaggtaacgtaagtaaaagtaaaaggtaagtagtagtacgtacgtacgtacgtacggtacggtacgtacgtactacctactacctacgaacgaacgtaactaacctaccaaacgaaacctaactacgtacgtactactacgtaacgtaaataacgtaaacgtaagtaagtagtaaggtaacggtacgtacggaacggaacggtacggtacgttacggttagtttacgtttaacgttacggtacggtaacgtaacggtacgtacggtaggtaggg

SEQ ID NO: 329126 - DNA, 573 bp, Homo sapiens
  misc_feature: GZ8MTXP02FXRE5.51.76.G10.1.454.CMB.2.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtacccagcaagaaacctggccaggcctcccgaggcctcctcatctatgatgcatccacaagggcccatgatacncccagccaggttcagtgcaggtggtctggggacaggtcgttcactctcaccatcagcagcctgcagtctagaagttatttgacttaatttattactgtacagtacaagttaattaactaacgttcggtaccttaccgttaacttacggttttacggacccgttaagggggaacccctaaaggtcgttacgggtaacttaactaaccgtaaaacggtaacgtaggttacgggacttacggacctaaccgtacg

SEQ ID NO: 329127 - DNA, 543 bp, Homo sapiens
  misc_feature: GZ8MTXP02J1EU7.51.76.G10.1.454.CMB.2.raw
  modified_base (258)..(258): a, c, t, g, unknown or other
  misc_feature (258)..(258): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (470)..(470): a, c, t, g, unknown or other
  misc_feature (470)..(470): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttcctcgttagctctttaagaggtgtccagtgtcaggtgcagctggtggagtcgtgggggaggcgtggtccaggccccgggaggtccctgagactctcctgtgcagcctntggattcaccttcagtgcctatggcatgcactgggtccgccaggcctcccaggccgaaggggtctgggaggtgggtggcatttanatcagatgatgganagtaaataaagagtangactagtccgtacgtaggacggaccgtattaccacctatccaccgaagaacgtaacaactacccaaacgaaccactactacgtactactagacaaanagaacagtagtagagacgagagacggacgacgcgtgtagttattcgtgtacgacgaacgacgtacgtagtagg

SEQ ID NO: 329128 - DNA, 510 bp, Homo sapiens
  misc_feature: GZ8MTXP02I1EJ6.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggcctcctcatctatgatgcatccacaagggccactgatatcccagccaggttcagtggcagtgggtctggggacaggagttcactctcaccatcagcagcctgcagtctagaagtatttgactaattttattacttgtcagtacagtataatacgtcggtacctacgtactacgtttcggaccgtaggggaccaagcgtaggacgatacgaaacgactgtcggctcgacactac

SEQ ID NO: 329129 - DNA, 513 bp, Homo sapiens
  misc_feature: GZ8MTXP02JMZ94.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttagcagcgacttagcctggtaccagcagaacctggccaggctcccaggcctcctcatctatgatgcatccagaagggcccactgatactccccagccaggttcagtggcaggtggggtctgggggacaggtacgttcacttctccaccatcagcagcctgacagtctagagtatttgactaatttattactgtcagtactagtataataactggtaccctacgtactacgtttcgcgtagggaccagcgtaggagatacaacgacgtagtacggactcgacacta

SEQ ID NO: 329130 - DNA, 512 bp, Homo sapiens
  misc_feature: GZ8MTXP02JZKM6.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggcctcctcatctatgatgcatccacaaggccactgatactcccagccaggttcagtggcaggtgggtctggggacagtagttcactctcaccatcagcagcctgcagtctagaagtatttgactaatttattactgtcagtcagtataataacgtgtaccttcgtactacgtttcggaccgtaggggaccaagcgtacggagagtacgaaacgtactaggtcggactcgacactag

SEQ ID NO: 329131 - DNA, 615 bp, Homo sapiens
  misc_feature: GZ8MTXP02GDU4T.51.76.G10.1.454.CMB.2.raw
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggacttcaccttcagtgcctatggcatgccagtcgggtccgccaggcctcccgaggccgaaggggctgggaggttgggnggctaagtttttanactcgagtatgatggactaagtaaataaaggagttatgacgtacgtccgtacggtaggaacgggtccgtataccacctactcctacgaagaacaacctaaccttacccaaacgaaaccacctacttacgttactactacgaactaaagtacgaaactagtaagttaggaagacggtacgtaggaacggaaccgtacggtacgttacggttacgtttacgtttcgtaggtacggaaccggtaaacgtacgttaaggtaggtaaggg

SEQ ID NO: 329132 - DNA, 499 bp, Homo sapiens
  misc_feature: GZ8MTXP02FR0A4.51.76.G10.1.454.CMB.2.raw
  modified_base (196)..(196): a, c, t, g, unknown or other
  misc_feature (196)..(196): n is a, c, g, or t
  modified_base (385)..(385): a, c, t, g, unknown or other
  misc_feature (385)..(385): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggcccactgatactcccagccaggttcagtggcaggtggtctggggacaggtagttcactctcaccatcagcagccctgcngtcagaagtatttgacttaaatttattactgtcagctaagtataataactggacctacgtactacgtttcggctaggggaccaaggctggacatacaacgatgacgctgcacta

SEQ ID NO: 329133 - DNA, 538 bp, Homo sapiens
  misc_feature: GZ8MTXP02IUBCO.51.76.G10.1.454.CMB.2.raw
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggagtccctgagactctcctgtgcagcctctggattcaccttcagtgcctatggcatgcacgtgggtcccgccagggcctccgagggccaaggggctgggaggtggggtgctatttanatcagatgatggactaagtaaatagngtangactagtctcggtagaagggcctatcacntcncaganacaatccaagacaacnctagtatctagacaaatcgaaacagtaattggaagagcgtaggacggacgacggtcgtagttgttactttcgaggtcgacgaaacgtctaagtaggtaggtaggggttaagggg

SEQ ID NO: 329134 - DNA, 535 bp, Homo sapiens
  misc_feature: GZ8MTXP02F2PGX.51.76.G10.1.454.CMB.2.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcactgggtccgccaggctccgaggcaaggggctggagtgggtggctattatatcagatgatggacaagtaataagngtatgcagtctcgtgaggcgatcacntctcagagacaatcccgaanaacacactagtatactagacaaanagaacagtagtagagagacgtaggacgacgacggtacgttacggttacgttacgtttcgtaggtaacgtaacgtaaacgtcgtaagtacggtagggttaggggtaaggg

SEQ ID NO: 329135 - DNA, 566 bp, Homo sapiens
  misc_feature: GZ8MTXP02GYEEA.51.76.G10.1.454.CMB.2.raw
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggattcaccttcagtgcctatggcatgcacgtgggcccgcaggctccgaggcgaaggggctgggagtcgggtgctagtttanactgagatgagtcggataagtaaagtaaagtagtatcgactacgttccgtacgtagaacgggtcctacttaccaacctactacctacgaagactaactaactaccacgaaacactactagtactactacgaacaataagaacgaagtagtagagacgacgtagacgacgacgtacgtacgttagttacgttaacgtagtacgtacgaacgtacgtacgtaggtagg

SEQ ID NO: 329136 - DNA, 521 bp, Homo sapiens
  misc_feature: GZ8MTXP02F99E2.51.76.G10.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggaccagcagaacctggccaggctcccaggctcctnatctatgatgcatccacaaggccactgatacnccagccaggtcagtgcagtggctgggacagagttcactctcacatcancagcctgcagtctagagtatttgacttaatttatacttgtctagataagtataataacgtgacctacgtactacgtttcggacgtacggggaccaaggtcgttaggaacgtagtaaccgaaaacgtaacgtacggttacggcgtacgaccaacgtacg

SEQ ID NO: 329137 - DNA, 505 bp, Homo sapiens
  misc_feature: GZ8MTXP02JBYIU.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcaagaacctggccaggctcccaggcctcctcatctatgatgcatccaacaagggcccatgatactcccagccaggttcaggtggctaggtgggtctggggacaggacgttcactctacaccatcagcagcctgcagtctgaagtatttgactaatttattactgtcagtcagtataatactgtcctacgtactacgtttcggacgtacggggacaagcgtagacgatacaaacgactaggtcgactgcactac

SEQ ID NO: 329138 - DNA, 614 bp, Homo sapiens
  misc_feature: GZ8MTXP02GXUP0.51.76.G10.1.454.CMB.2.raw
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcctcgttgctcttttaagaggtgtccagtgtcaggtgcagctggtggagtcgtgggggagcgtggtccaggcccgggagtccctgagactctcctgtgcagcctgtggattcaccttcagtgcctatggcatgcactggggtccccncgaggcncgaggacgaggggtctgggtaggtgggtgactatttanatcgagtagtgagtcggataaagtaaagtaagtagtacgtgactacgtccgtacgggtagggaaccggtaccgtactaccaacctactacccgtacgaagaacgtaacctaaccgtacccaaagaaacctactaacgtagttactactacgaaactaaagtacgaaacgtaagtaagtagtagagtacgtacggacggacgtacggtacgttacgttacgttacgttacgtacgtaacgtacgtaacgtacgtagtaggtagggtagggtaaggg

SEQ ID NO: 329139 - DNA, 536 bp, Homo sapiens
  misc_feature: GZ8MTXP02HG096.51.76.G10.1.454.CMB.2.raw
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccaggccccgggaggtccctgagactctcctgtgcagcctntggattcaccttcagtgcctatggcatgccacgtggggtcccnccgaggcctccgaggccgaagggggctgggaggtggggtgctaatttanatcagatgatggacagtaaataaagagtatgnagtctcgtgaggcgatcacatcctcagagacaactaccaacgaaacacactagtatactacgacaaatagaaacaagtagtagagagacgtaggacggacgacggcgtcgtagttagttcgtgtacgtacgaacgtcgtaaaaagtgtaggg

SEQ ID NO: 329140 - DNA, 549 bp, Homo sapiens
  misc_feature: GZ8MTXP02G53NO.51.76.G10.1.454.CMB.2.raw
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtcgggtccgccaggcctccgaggcgaaggggctgggagtgggtggctagtttanactnagatgagtggactagtaaagtaaaggagtagtgcgtagtcgtaccgtaggaacggctatccacctatccacgaagacactactaccaanaacacagtntactacagacaagtagaaacagtagtagagtacgngtaggacggacgacggtctacggttattacgttcgtaggtacggtacgtaacgtcgtaggtaggtacgg

SEQ ID NO: 329141 - DNA, 537 bp, Homo sapiens
  misc_feature: GZ8MTXP02GHZK3.51.76.G10.1.454.CMB.2.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
  modified_base (456)..(456): a, c, t, g, unknown or other
  misc_feature (456)..(456): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtcgggtccgccaggcctccgaggcgaaggggctgggaggtgggtggctagtttanactcagatgatggacagtaaanaaagagtangcagtctcgtagaacggccgattcacatctaccaganacaattacccaagaacactactagtactctagacaaatgaaacngtaattagaagagcgtaggacggaacgacggtcttagtagttactttcgtgtacgacgtaaacggtctaagtggtaagggg

SEQ ID NO: 329142 - DNA, 513 bp, Homo sapiens
  misc_feature: GZ8MTXP02HFKR8.51.76.G10.1.454.CMB.2.raw
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggacttcaccttcagtgcctagtggcatgccacgtcgggtccgccaggcctccgaggccgaaggggctgggagtggggtgctatttanactcagatgatggcagtaaataaagntatgacagtctcgtgacggcatcacatcncagagacaatcccagaaccacatacgtatctgacaaatgaaacagtatagagacgcgtaggacggacgacggtctagtgttattcgtagtacgacgaaaccgtctagtggtagg

SEQ ID NO: 329143 - DNA, 501 bp, Homo sapiens
  misc_feature: GZ8MTXP02I1FVL.51.76.G10.1.454.CMB.2.raw
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggaggtccctgagactctcctgtgcagcctctggattcaccttcagtgcctatggcatgcacgtgggtccgccaggcctccgaggcaaggggctgggagtggggtgctatttanatcagatgatggcagtaataaagngtatgcagtcncgtgaggcatcacanctcaganacatacccagaacacactgtatcctagacaaatgaaacagtaagtagagagctaggacggacacggtctagtgttattcgtgtgacgaacgctagtggtagg

SEQ ID NO: 329144 - DNA, 530 bp, Homo sapiens
  misc_feature: GZ8MTXP02HKWXI.51.76.G10.1.454.CMB.2.raw
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtccnccaggcctccgaggcgaaggggctgggagtgggtgctatttanatcagatgatggacagtaaataaagngtangacagtctcgtaggacggcgatccacatcctacagacgacaactacccaagaaaccacactagtactactagacaaatacgaaacagtatagagtacgcgtagacggacacggtctagtgttatttccgtgtacgacggaacgtcgtaggtaggtaagggg

SEQ ID NO: 329145 - DNA, 579 bp, Homo sapiens
  misc_feature: GZ8MTXP02J3IW5.51.76.G10.1.454.CMB.2.raw
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgagactctcctgtncagcctctggacttccaccttcagtcgcctatggcatgcacgtcgggtcccgccaggcctccgaggcgaaggggctgggagtgggtgctatttanctcagatgatggactagtaaataaagngtatgactacgtctccgtaggaacggccgtattaccacntacctaccagaacgactaacttaccccgaagaaccacactagtactcgtanactaaatagaaacgagtaataggagtacgacgaggacggaccgacggtctaggttagtttaacgtttcgtacggtacggaaccggtaaaacgtcgttaaggtaggttaacggggg

SEQ ID NO: 329146 - DNA, 527 bp, Homo sapiens
  misc_feature: GZ8MTXP02G4NP0.51.76.G10.1.454.CMB.2.raw
  modified_base (288)..(288): a, c, t, g, unknown or other
  misc_feature (288)..(288): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcctgcatagtatggatacaactattggattggcacctgcagaagccagggcagtctccanaggtcctgatctatttgagttctaagtccccggggcccccggggtcctgactaggttcagtggcaggtggatcgaggcacagtatttaatactagaaaatcgagcagagtggagntagaggtagtggtttggggttatgtattgntatgacaagctactaactaaactcctactacgtactttcgggacggacgggtaccgaaagggcggaacgacgtacgaacgacgtaacgtggtcg

SEQ ID NO: 329147 - DNA, 554 bp, Homo sapiens
  misc_feature: GZ8MTXP02HOBXA.51.76.G10.1.454.CMB.2.raw
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccccgggaggtccctgagactctcctgtgcagcctctggattcaccttcagtcgcctatggcatgcaccgtggtccgccaggctccgaggcgaaggggctggagtgggtgctatttanatcagatgatggacaagtaaataaggngtaatgctagtctacgtaggaacgggccaattcaccatctaccagacacaacttacccaagaaacncacttgtatctagacaaatgaaacagtagttagaagngactaggacggacacgggttnttacggtagttactttcggagtaacggaacgtaaacgtcgtaggtacggtagggtttaggggtaagg

SEQ ID NO: 329148 - DNA, 614 bp, Homo sapiens
  misc_feature: GZ8MTXP02FTGD5.51.76.G10.1.454.CMB.2.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgattagctggaccagcagaacctggccaggcctcccgaggcctcctcatctatgatgcatccacgaagggcccatgatacncccagccaggttcagtggctaggtggtctggggacaggtcgttccactctcacatcagcagcctgcagtctagtaagttatttgacttaatttaacttacgttgtaccgtaagtacgtaaagttaattaaaacgtaacgttacgggtaccccttacgttacctttaaccggtttttaccgggaacccggaaccgggggttaaaccaaaacgggtccgttacggggaaaacgtaacgttaaaccgaaaaaccggttaaacgttcgggtacggtccttacggacctaacctttaaccg

SEQ ID NO: 329149 - DNA, 570 bp, Homo sapiens
  misc_feature: GZ8MTXP02HB390.51.76.G10.1.454.CMB.2.raw
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (503)..(503): a, c, t, g, unknown or other
  misc_feature (503)..(503): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtcgcctatggcatgcacgtggggtcccnccaggcctccgaggcgaaggggctggaggtggggngctaagtttanatcagatgatggacaagtaataagntatgactagtctcggtaggaacgggccgtattccgacatcctaccgagacgactaactacccaagaaaccactactagtactctagactaaaagtgaaacagtaattggaagacgactaggacggacgacggtnttggttacgttactttgtggtaacgtacgaaaaccgtctaagtcggtaagggttaggggtaaagggg

SEQ ID NO: 329150 - DNA, 536 bp, Homo sapiens
  misc_feature: GZ8MTXP02F1OXQ.51.76.G10.1.454.CMB.2.raw
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccnccaggcctccgaggcgaaggggctggaggtgggtgctatttanatcagatgatggcagtaataaagngtatgcagtctcgtgaaggccattcacatctacagagacacttcccaagaacacgactagtactctagacaaatcgaaacagtatgaagacgacgtaggacggacgaacgggtcttaggtacgttattttcgaggttacggaccggtaaaacgtcgtaagtaggtaaggggg

SEQ ID NO: 329151 - DNA, 524 bp, Homo sapiens
  misc_feature: GZ8MTXP02GU12A.51.76.G10.1.454.CMB.2.raw
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtaagtgcagctggtggagtctggggaggcgtggtccgagcccgggacggtcctcgagactctcctgtgcagcctctggattcaccttcagtgcctatggcatgcactgggtccgccaggctcccaggcaaggggctggagtgggtggcatttatatcagatgatggcagtaaattaaagngtatgcagtntccgtgaagggcccgtattcacccaatcgtccaggactacaaacttccccagaactacaacctgtaatcctnacaaatagaanaanatagagagagagaggacgagtgtgtgtgttattnttgtgtacgaacgtacgtagtagtaggtagggtaggg

SEQ ID NO: 329152 - DNA, 500 bp, Homo sapiens
  misc_feature: GZ8MTXP02FVGZJ.51.76.G10.1.454.CMB.2.raw
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
  modified_base (453)..(453): a, c, t, g, unknown or other
  misc_feature (453)..(453): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctctggattcaccttcagtgcctatggcatgcacgtgggtccgccaggctccgaggcaaggggctggagtgggtggctatttanatcagatgatggcagtaanagagtatgcagtctcgtgaggcgattcacatcncagagacataccagaacacactgtatctagactaaangaaacagtattgagagctagaggacacggntaggtacgttagttctgtgacgaaacgtctagtgaggtgggtaaggg

SEQ ID NO: 329153 - DNA, 661 bp, Homo sapiens
  misc_feature: GZ8MTXP02F2CTZ.51.76.G10.1.454.CMB.2.raw
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccaggccccgggaggtccctgagactctcctgtgcagcctctgattcaccttcagtncctagngcangcncgtcggcccncgagcctacgaggacggaagggcgtgggaggtgggtgtactaagtttaatagtcgagtagtagagtagtagtaaagtaaaagtaagtaagtagtagtacgtacgtacgtacgtacggaacgggtaccgtacgttaccgtaacctactaccgtaccgaacgaacgtaaacgtaaacctaacccgtaaacgaaacctaaacctaacgtaacgttacgtacgtacgtaaacgtaaaacgtaaacgtaaacgtaagtaagtaagaagagtacgtacggaacggaacgacggtacgttacgttacgtttacgtttacgttacgtaacggtaaacggtaaacgtacgtaaggtaggtagggttaaggggtaaggg

SEQ ID NO: 329154 - DNA, 517 bp, Homo sapiens
  misc_feature: GZ8MTXP02GPJE1.51.76.G10.1.454.CMB.2.raw
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccccgggaggtccctgagactctcctgtgcagcctctggattcaccttcagtgcctatggcatgcacgtgggtcccgccagggcctccgaggcaaggggctgggagtgggtggctatttanatcagatgatggacaagtaataagngtatgcagtctcgtagaaggccgatcacatctccagagacaactcccaagaaacacatgtatctagacaaatgaaacagtatgaagagctagagacacggctgtacgttattcgtagtaacgtacgaaacgctagtggtaggtgggtaaggg

SEQ ID NO: 329155 - DNA, 541 bp, Homo sapiens
  misc_feature: GZ8MTXP02F35IS.51.76.G10.1.454.CMB.2.raw
  modified_base (151)..(151): a, c, t, g, unknown or other
  misc_feature (151)..(151): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccaggcccgggaggtccctgacgactctcctgtgcagcctcgtggacttccaccttnagtcgcctagtggcagtcgcacgtcgggtcccncagggcctaccgaggccgaaggggctgggagtgggtgactatttanagtcagctgatggactaagtaatagntatgctagtctacggagacgctatcactntcacagacgacactaccagacacactgtatctagactaagtgaactgtactgagagtcgtaggacgacgtacggtcttaggtacgttacttcgagtaacgaacgtaacgtcgtagtacggtaggtacggttaaggg

SEQ ID NO: 329156 - DNA, 502 bp, Homo sapiens
  misc_feature: GZ8MTXP02I0AFZ.51.76.G10.1.454.CMB.2.raw
  modified_base (256)..(256): a, c, t, g, unknown or other
  misc_feature (256)..(256): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctntggattcaccttcagtgcctatggcatgcacgtgggccgccaggcctccgaggcaaggggctgggagtgggtgctatttaactcagatgatggcaggtaaataaagngtatgcagtctcgtgaggcatcacatcctacagagacacttacccagaacacactgtactcagacaatgaaacagtatgagagctaggacggacacggtctaggtgttattcgtgtacgacgaacgtctagtcgtaggg

SEQ ID NO: 329157 - DNA, 505 bp, Homo sapiens
  misc_feature: GZ8MTXP02I5L7A.51.76.G10.1.454.CMB.2.raw
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccgaggcgaaggggctggagtgggtgctatttanatcagatgatggcagtaanaaagagtatgcagtctcgtgaggcgatcacntcncanagacactaccagaacacactgtatctagacaaatagaaacagtatagagagacgtaggacggacgacggtctagtgttattcgtgtacgacgtaaacgcgtagtaggtaaggg

SEQ ID NO: 329158 - DNA, 558 bp, Homo sapiens
  misc_feature: GZ8MTXP02JYYBQ.51.76.G10.1.454.CMB.2.raw
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgcccaccctctcctgcagggccagtcagagtgttagcagcgacttagcctggtaccagcagaaacctggccaggcctcccgaggcctccncatctatgatgcatccaagaacggccatgactactcccagcctaggttcaggtggactaggtgggtcgtggggacaggtacgttcactctacaccgtatcagcagcctgcagtctagtaagtatttgacttaatttatactagtcagactaagttaataaacgtacgtcggtcccttaccgtacttacgtttcggacccgaggggaaccctaaggtcgtacggacgtaactaacgaaaacggacttaggtcgactcggacctacgtacg

SEQ ID NO: 329159 - DNA, 602 bp, Homo sapiens
  misc_feature: GZ8MTXP02IJBYW.51.76.G10.1.454.CMB.2.raw
  modified_base (342)..(342): a, c, t, g, unknown or other
  misc_feature (342)..(342): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctgggtggagtcgtgggggagcgtggtccaggcccgggaggtccctgagactctcctgtgcagcctctggattcacttcagtgctatggcatgcacgtgggtccgccaggcctccgaggcgaaggggctgggagtggggtgctagtttanactcgagtatgagtggaactagtaaataaaaggagttaacgtaggaacgttcgtaccggtaggaacggaccgtatacaacctactaccaccgaagaacgaactaactacccaaagaaaccaactacgttagtactacgtacgaactaaagtacgaaactaacgtaagtagtagacgtacgtaggaacggaacgtacggtacgtacgttacgttagttacgttaagtacgtacgtaacgtacgtacgtacggtaggtaggg

SEQ ID NO: 329160 - DNA, 533 bp, Homo sapiens
  misc_feature: GZ8MTXP02G7OUS.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggcctcctcatctatgatgcatccacaagggcccactgatactcccagcctaggttcaggtggcaggtgggtctggggacaggtacgttcactctcaccatcagcacgcctgcagtctagaagttattttgacttaatttattatgtcagtactagtataataacgtcggaccttaccgtactacgttttcggaccgaggggaccaaggtcgtaggacgactacgaaaacgtacgtaggtcggactcggaccactacg

SEQ ID NO: 329161 - DNA, 511 bp, Homo sapiens
  misc_feature: GZ8MTXP02F60OX.51.76.G10.1.454.CMB.2.raw
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcactgggtccgccaggctccaggcgaaggggctggagtgggtggctattatatcagatgatggcaagtaaataagagtatgcagtctcgtgaagggcatcacatctaccagagaacaactcccaagaaacacactagtanctagacaaatgaacaagatagagagngagaggacgacgngtagtgtacgttntgtgtacgaaacgactagtagtaggtagggtaagggg

SEQ ID NO: 329162 - DNA, 538 bp, Homo sapiens
  misc_feature: GZ8MTXP02HG5MF.51.76.G10.1.454.CMB.2.raw
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttcagtcgcctatggcatgcacgtggggtcccnccagggcctccgaggcgaaggggctgggagtggggtggctatttanatcagatgatggacaagttaataagngtatgacagtctacggtgaacgggccgattcacatcncaganactaatcccaagtaaccacgactcgtaatctagacaaaagtgaaactagattagagagctaggaacggacgacggnttacggtagtacttcgtagtcgacgaaaccgtctagtaggtaggtaggtagg

SEQ ID NO: 329163 - DNA, 670 bp, Homo sapiens
  misc_feature: GZ8MTXP02H1NK6.51.76.G10.1.454.CMB.2.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagtcctcgtggtacttccaccttcagtcgcctagtggcagtgccacgtcggggtcccnccagggcctcccgagggaccgaagggggtctaggggaggtggggtgctaagttttanactgaagtagtagacgtgggataaaggttaaaataaggagttaactgtaccgtaagttccgtaccggtagggaaacggacccgtatttaccaacctactcccgtaccgaagaacgaaaccctaaacttacccgaaacaaaccactaacgtacgtttaactacgtacgtaacctaaaagttacgaaaaccgtaagttaagttaaggaagtacggacgtagggaaacggtaccgaacggtcgttagttacgttatttcgtagtaacgtaccgaaaacgtcgtaagtaggagggttaggggtaaagggg

SEQ ID NO: 329164 - DNA, 591 bp, Homo sapiens
  misc_feature: GZ8MTXP02GX117.51.76.G10.1.454.CMB.2.raw
  modified_base (188)..(188): a, c, t, g, unknown or other
  misc_feature (188)..(188): n is a, c, g, or t
  modified_base (346)..(346): a, c, t, g, unknown or other
  misc_feature (346)..(346): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggagtccctgagactctcctgtgcagcctctggattcaccttcagtgcctatggcatgcacgtcgggtccgccaggcctaccgaggccgaaggggctgggagtggggtgactagttttanactacgagtatgagtaggactaagtaaataaagagtactgactagtccgtacgtaggaacggtcctactaccaacctactcctacgaagaacacctaactaccaaagaaacctactactagtactacgtagaactaaatacgaaacgagtagtagaacgtacgtacgtaggaacggacgtacggtcgttacgttagttacgttaacgtacggtaacgaacgtaaacgtcgtaaggtaggtaaggg

SEQ ID NO: 329165 - DNA, 534 bp, Homo sapiens
  misc_feature: GZ8MTXP02IOMSJ.51.76.G10.1.454.CMB.2.raw
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (471)..(471): a, c, t, g, unknown or other
  misc_feature (471)..(471): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccccgggaggtccctgagactctcctgtgcagcctctggattcaccttcagtgcctatggcatgcacgtggggtcccnccaggcctcccgaggccgaagggggctgggaggtggggngctatttanatcagatgatggactaggtaaataaagagtatggacagtctccgaggaacgggcctagtccaacctatcctccagacgactaacttacccaagaaccacactgtatactagacaaatgaaacngtaatagagagctgacggacgacgctagtgttattcgtgtcgacgaacgtctagtaggtaggg

SEQ ID NO: 329166 - DNA, 684 bp, Homo sapiens
  misc_feature: GZ8MTXP02H5LO9.51.76.G10.1.454.CMB.2.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtctgggggagcgtggtccagcccgggaggtccctgagactctcctgtgcagcctntggattcaccttnagtgcctatggcatgcagtcgggtccnccagggcctccgaggcaaggggctagggaggtggggtgctagtttttaanatgagtagtagagtggactaaagttaaagtaagtgttancggtacgtagttccgtacggtagggaaaccgggtccgtaacgttacccaaccgtactacccgtaccgtaaacggaaactaaaccgtaaccttacccgaaacgtaaaccctacgtaaccgttagtaactacgtaacgtaaactaaaacgtacgaaacgtaagtacgttaaggaaacgtacgtaacgtaacgggaacggtaaccggtacggttacgttaggttacgtttacgtttcggtaggttaaccggaaccgtaaaacggtcgttaaggtacggggtaacggggttaagggggtaacgggg

SEQ ID NO: 329167 - DNA, 590 bp, Homo sapiens
  misc_feature: GZ8MTXP02IYMU8.51.76.G10.1.454.CMB.2.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccccgggagtccctgagactctcctgtgcagcctgtggattcaccttcagtgcctatggcatgcncgtgggccncaggcctccgaggcaaggggctgggagtgggtgctagtttanagtcagatgatggacagtaaagtaaagacgttatggactagggttcctaccggtaggaaacgggcccgtattacccaacctatcccgtacaaggaacaacctaacgtttacccaaacgaaaccaaccgtacttagttactcctagaactaaatcgaaaacgngtaagtgacgagacgtaggacggacgacggtcttggtagtttacttcgtgttaacggaccggtaaacctacgtagtagggttaacgggg

SEQ ID NO: 329168 - DNA, 566 bp, Homo sapiens
  misc_feature: GZ8MTXP02ID0D5.51.76.G10.1.454.CMB.2.raw
  modified_base (281)..(281): a, c, t, g, unknown or other
  misc_feature (281)..(281): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagagtgttagcagcgacttagcctggtaccagcagaaacctggccaggctcccaggctccncatctatgatgcatccaacgaagggcccatgatatccccagccaggttcagtggcaggtgggtctggggacaggtagttcactctcaccatcagcacgcctgcagtctagaagtatttgtacttaaactttattacttgtctagactaagttataattaacgtcggtaccttaccgtacttaccgtttttacgggaccgtacgggggaccgtaaacggaccgtagggaacgtataaccgaaaacgtaaaccgttaggttacggaccgttacggaccaaccgtacg

SEQ ID NO: 329169 - DNA, 537 bp, Homo sapiens
  misc_feature: GZ8MTXP02JUO1W.51.76.G10.1.454.CMB.2.raw
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccgggaggtccctgagactctcctgtgcagcctctggattcaccttcagtgcctatggcatgcacgtgggtcccgccaggcctccgaggccaaggggctggaggtggggtggctatttanatcagatgatggcaagtaatagagtatgcagtctcgngaggccatcacntcncaganacactccagaacacactgtatctagacaaatgaaacagattgaagagacgtaggacggacgacgggtactggttagttaacttttcgtaggtcgtaacggaaacgtcttaagtaggtagggtagggggttaaaggggg

SEQ ID NO: 329170 - DNA, 530 bp, Homo sapiens
  misc_feature: GZ8MTXP02G3HOJ.51.76.G10.1.454.CMB.2.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (466)..(466): a, c, t, g, unknown or other
  misc_feature (466)..(466): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctctgtgcagcctntggattcaccttcagtgcctatggcatgcacgtgggtcccnccagggcctccgaggcgaaaggggctgggaggtggggtggactatttanatcagatgatggacaagtaaataagagtatgcagtctccgtagaacgggctattcaccatcctacagacgaactaactacccaagaaaccacactagtatctagacaaatgaaacagatgagngactggagacacggctgtacgtatttcgagtaacgacgaaacgctagtggaggtagggtaaggg

SEQ ID NO: 329171 - DNA, 562 bp, Homo sapiens
  misc_feature: GZ8MTXP02H3A6Z.51.76.G10.1.454.CMB.2.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatctcctgcaggtctagtcagagcctcctgcatagtatggatacaactattggattgcactgcaganccagggcagtcncanagtctgattctattgatctaagtccccggggcccccgggtcctgaacnggttcagtggctagtcggatcgaaggcacagtattttaaanaacgtaagaaaatanagacgagagaggaggagtaggaggtaggttaggtttagggttagtagtagtagtagtagtagacgaacgtactactaaactaaacctacctacgtaacgtacgttacggtacggaacgggaacggaacggtaaggtaacgtaacgtaacgaacgaacgtaacgtacggtacgg

SEQ ID NO: 329172 - DNA, 505 bp, Homo sapiens
  misc_feature: GZ8MTXP02FNB0A.51.76.G10.1.454.CMB.2.raw
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacagggctgggagaggagcccagcactagaagtcggcggtgtttccattcggtgatcagcactgaacacagaggactcaccatggagttgggctgagctgggttttcctcgttgctcttttaagaggtgtccagtgtcagtgcagctgtgagtcgtgggtaggcgtggtccagcccgggaggtccctgagactctcctgtgcagcctctggattcaccttcagtgcctatggcatgcacgtgggtccgccaggctccgaggcaaggggctggaggtggggtggctatttatactcagatgactggcagtaaactaaagngtatgcagtctccgtagaaaggggcccgaattcaccatctacccaagngacactcccagaaccncactgtatctgacaaatgaaacagatgacgagctgacgacacggctgtgtattctgtcgacgaaacgctaagngtaggg

SEQ ID NO: 329173 - DNA, 541 bp, Homo sapiens
  misc_feature: GZ8MTXP02GP2JC.51.76.G10.1.454.CMB.2.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtcgcctatggcatgcacgtcgggtcccnccgaggcctccgaggcgaaggggctgggaggtgggtgctatttanatcgagatgagtggacagtaaanaaagagtatgcagtctcgagaggcgatcacatcacagacgacactacccaagaacacacttagtactcgtagaactaaatacgaaactagtaagttagaagagtcgtaggaacggaacgacggtcttacggttgttattcgtcgtacgacgaaacgtcgtagtaggtaagggg

SEQ ID NO: 329174 - DNA, 605 bp, Homo sapiens
  misc_feature: GZ8MTXP02G2312.51.76.G10.1.454.CMB.2.raw
  modified_base (348)..(348): a, c, t, g, unknown or other
  misc_feature (348)..(348): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgccacgtcgggtccgccaggcctaccgaggcgaaggggctgggacggtggggtgctagttttaanacgtcgagtagtgagtggaacgtaagttaaagtaaaggtagttacgtcgtacgtacgttccgtacggtaggaacggtacctactaccacctactccacgaagaacgaacctaactaccgaaacgaaccactacgtagtactactacgaacaaagtacgaaacgtagtagtagacgtacgtacgtaggacggtacgtacggtcgtacgttagtttacgttcgtacggtacgtaacgtaacgtacgtaggtaggtaggg

SEQ ID NO: 329175 - DNA, 542 bp, Homo sapiens
  misc_feature: GZ8MTXP02GWM6V.51.76.G10.1.454.CMB.2.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagccaccctctcctgcagggccagtcagagtgttagcagcgacttagcctggtaccagcagaacctggccaggcctcccaggctcctcatctatgatgcatccanaagggcccactgatactcccagcccaggttccaggtggcaggtcggggtcgtgggggacaggtagtttccacgttctcaaccatcagcacgcctgcagtctagaagtatttgactaatttattacttgtacagacaagtataaataactcgtcctaccgtactacgtttcggaccgtaggggaccaaggtacgtaggacgacgtacaaaacgtacgtaggtcggactacggacactacg

SEQ ID NO: 329176 - DNA, 496 bp, Homo sapiens
  misc_feature: GZ8MTXP02JY5OV.51.76.G10.1.454.CMB.2.raw
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggaggtccctgagactctcctgtgcagcctctggattcaccttcagtgcctatggcatgcactgggtccgccaggctccgaggcaaggggctgggagtgggtgcatttanatcagatgatggcagtaataaagngtatgcagtctccgtgaaggcgattcacatctcagagacaattcccagaaccacactgtatctgacaaatgaacagtattgagagctagacggacacggctgtgtattcgtagtcgacgaaacgctaagtgagg

SEQ ID NO: 329177 - DNA, 608 bp, Homo sapiens
  misc_feature: GZ8MTXP02HCW9N.51.76.G10.1.454.CMB.2.raw
  modified_base (358)..(358): a, c, t, g, unknown or other
  misc_feature (358)..(358): n is a, c, g, or t
  modified_base (456)..(456): a, c, t, g, unknown or other
  misc_feature (456)..(456): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtagtgcagctggtggagtcgtgggggagggcggtggtccgagcccgggacggtcccgtcgagactctcctgtgcagcctctggattcaccttcagtgcctatggcatgcactcgggtcccgccaggctccgaggcgaaggggcgtggaggtgggtggctagtttatatcagatgatgganagtaaagtaaagaggtatagcgtaagtccgtacgagggtaaacgggcccgtatttacccacctatcctccgaaagcgaactaaacttcccccgaaaanaaccacacttagtacttcagaacaaatacgaacaggtatagacgagtcgaggtaggactggttggtcgttagtttacgttacgttttcggtaggtaacggtaaacgaaaccggttacgtaaggtacggggtaagggggttaggggttaaggg

SEQ ID NO: 329178 - DNA, 544 bp, Homo sapiens
  misc_feature: GZ8MTXP02GN3B4.51.76.G10.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccagctccnatctatgatgcatccagaacggccactgatactcccagccaggttcagtggctagggtcggtctggggactaggtacgttcactctcaccatcagcacgcctgcacgtctagtaagttatttgacttaatttattaacttgtactaggtactaagttaataataacgtcggtacccttaccgtacgttacgtttacggaccgtaacggggaccaaggcgtaggacgataacgaaacgtacgtcgtacggctacgaccactacg

SEQ ID NO: 329179 - DNA, 504 bp, Homo sapiens
  misc_feature: GZ8MTXP02G8X0A.51.76.G10.1.454.CMB.2.raw
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccgccaggcctccgagggcaaggggctgggaggtggggtggctagtttanatcagatgatggacagtaaataaagngtatgacagtctcgtgaggcgatcacatcncaganacatccagaacacatgtanctgacaaatcgaaacagtatagaatagctaggacgacacgtctagtagtatttcgngtacgacgaaacgctagtggtagg

SEQ ID NO: 329180 - DNA, 558 bp, Homo sapiens
  misc_feature: GZ8MTXP02IQS6E.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccacctctcctgcagggccagtcagagtgttagcagcgacttagcctggtaccagcagaaacctggccaggctcccaggcctcctcatctatgatgcatccacaacgggcccactgatactccccaagccctagggttcaggttggctaggttcggggtctgggggactaggtacgtttaccacgtctcaccatcagcacgcctgcagtctagtaagtatttgacttaattttattacttgtctagactagttataataactacggtccttacgtactacgttttacggaccgtacggggactaagcgtaggaacgtaatacgaaaacgtaacgtaggttacggactacgtacacctacg

SEQ ID NO: 329181 - DNA, 531 bp, Homo sapiens
  misc_feature: GZ8MTXP02JV836.51.76.G10.1.454.CMB.2.raw
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggngtggtccagcccgggaggtccctgagactctcctgtgcagcctctggattcaccttcagtgcctatggcatgcacgtgggtccgccaggcctccgaggcgaaggggctggaggtggggngctatttanactcagatgatggacagtaaanaaagngtatgcagtctcgtgaaggcgatcacatctccgaagacgacaacgttacccagaaccactactgtactctagacaaatgaacagattagaagagactaggacgaacgacggtactcgttagtactttcgtaggtacgacgtaaaacgcttagtaggtaagggg

SEQ ID NO: 329182 - DNA, 584 bp, Homo sapiens
  misc_feature: GZ8MTXP02FJBG3.51.76.G10.1.454.CMB.2.raw
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (274)..(275): a, c, t, g, unknown or other
  misc_feature (274)..(275): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcgcgttaggctctttaagaggtgtccagtgtcaggtgcagctggtggagtctgggggagcgtggtccagcccgggagtccctgagctctcctgtgcagcctntggattcacccttngtcnctgtgcnngcncgtcggccgcgcgcgcgagagaggngtggnggtggtggtntattatatagagagtgagtagagtaagtaaagtaagtaagtagtagtacgtacgtacgtacggtagggtacgggtacgtacgtaccgtaactactactaccgacgaacgaactaacctaccgaacgaaacaactaactacgtacgtacgtacgtaactaaacgtaacgaagaagtaagtagagagacgtacgacggacgacgtcgttacgttacgttacgttcgtagtaacgtaacgtaacgtacgtagtaggtaggtagggtagg

SEQ ID NO: 329183 - DNA, 505 bp, Homo sapiens
  misc_feature: GZ8MTXP02JPYUY.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacaaggccactgatatcccagccaggttcagtgcaggtggtctggggacaggtagttcacgtctcaccatcagcacgcctgcagtctagaagtatttcgacttaatttattactgtcagactagtataatactggtaccttacgtactacgtttcggccgtaggggaccaagcgtagacgatacaacgtactgtacgctcgacactac

SEQ ID NO: 329184 - DNA, 623 bp, Homo sapiens
  misc_feature: GZ8MTXP02J34WR.51.76.G10.1.454.CMB.2.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (275)..(276): a, c, t, g, unknown or other
  misc_feature (275)..(276): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttccgtcgttaggctctttaagaggtgtccagtgtcaggtgcagctggtgagtcgtgggggagcgtggtccaggcccgggaggtccctgagctctctgngcncnctctgtntctctcngtcnctngnntgcgcgtcggccgccgcgcgcgacggacggaggcgtggtggtggtgtagtattatactgagagtagagtagtagtagtaaagtaaagtaagtagtagtacgtacgtccgtaccggtacggtaacggtacccgtaaccgtaccgtaccgtacgtacctacgaacgtaacgtaaacctaaaccgtaacccgaaaccgtaaacctaacgtacgtacgtacgtacgtaacgtaacgtaaacgtaacgtaaacgaagtaagtaagtaagtacgtacgtacggaacggacgtacgtcgtacgttacgttacgttcgtacggtacgtaacgtaacgtacgtacggtaggtaggg

SEQ ID NO: 329185 - DNA, 559 bp, Homo sapiens
  misc_feature: GZ8MTXP02H07OW.51.76.G10.1.454.CMB.2.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccaggcccgggagtccctgagactctcctgtgcagcctctggattccacttcagtcncctatggcatgcctacgtcgggtcccgccaggcctccgaggcgaaggggctgggagtggggtgctatttanactcagtatgatggacagttaaataaagngtangcagtccgtacgtaggaggccgtatccacatcctacagaacgactaactcccaagaacactagtntatcagaaccaaatcgaaacagtagttaggaagtacggactagggaacgtacgtacggtctacgtttgttactttcgtggttacgacgtaaacgtcgttaaggttaggaagggg

SEQ ID NO: 329186 - DNA, 537 bp, Homo sapiens
  misc_feature: GZ8MTXP02HUVQN.51.76.G10.1.454.CMB.2.raw
  modified_base (231)..(231): a, c, t, g, unknown or other
  misc_feature (231)..(231): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccaggtgggatattgtgatgactcagtctccactctccctgcccgtcacccctggagagccggcctccatctcctgcaggtctagtcagacgcctccngcatagtattggatacaactattggattggcactgcagaagccagggcagtcaccacaggtcctgatctattgattctaagtcccggggcccccgggtcctgacgtaggttcagtggcagtggatcaggcanagtatttanactagaaaatcaganagagtaggagagtagaggtagtaggtttaggggtttagttagtagttagtagtagtagacgaagtactactaactaactactactacgtacgttacggtacggacggaacggaaggtaaggaagaacgtacgaacgacgtaacgtacgtg

SEQ ID NO: 329187 - DNA, 562 bp, Homo sapiens
  misc_feature: GZ8MTXP02IBI2E.51.76.G10.1.454.CMB.2.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (437)..(437): a, c, t, g, unknown or other
  misc_feature (437)..(437): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcactggggtccccncgagctcgaggcgaggggctggaggtgggtgctatttanatcgagagtgagtggactaaagttaaataagtagttacgtgactagtccgtacggtaggaacgggcctataccactactcctacgagaacaactaactacccaanaaaccactactagtactactagaacaaagtaagaacgagtagtagagagacgacgaggacgacgtacgtacgttacgttacgttcgtgtaacgtacgaacgtacgtagtaggtaggtagggtagg

SEQ ID NO: 329188 - DNA, 527 bp, Homo sapiens
  misc_feature: GZ8MTXP02G344D.51.76.G10.1.454.CMB.2.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcacgtgggtccnccaggcctccgaggcaaggggctgggagtggggtggctatttanatcagatgatggacaagtaatagagtatgcagtctccgtaggaaggccgattcacatcctcagagacaattcccaagaacacactgtatctagacaaatagaacagattagagagctagagggacacgggactggtagttactttgtagtcgtacgaaaacgtctagtacggtaaggtaggggttaagggg

SEQ ID NO: 329189 - DNA, 578 bp, Homo sapiens
  misc_feature: GZ8MTXP02GI3UR.51.76.G10.1.454.CMB.2.raw
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcacgtcgggtcccgccaggcctccgaggcgaagggggctggggaggtggggtggctaagttttanagtcaagtatggatgggacagtaaanaaagagtatgcagtctccgtggacggccgattccgacctatcctacagacgactaattccccaagaaaccacactgtaactactagaactaaatacgaaaacgagtaagttagaagtaagccgtaggaacggaacgacgggtctacggttagttagttttccgtagttacgacggtaaaccgtcgtaagtggtaaaggggg

SEQ ID NO: 329190 - DNA, 498 bp, Homo sapiens
  misc_feature: GZ8MTXP02FQNRB.51.76.G10.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattcaccttcagtgcctatggcatgcactgggtccnccaggctccgaggcaaggggctgggagtgggtgctatttanatcagatgatggcagtaataaagngtatgcagtctcgtgaaggcgattcacanctcagagacaatccagaacacactgtatctagacaaatgaaacagtatgagacgctaggacggacacggctgtgttattcgtgtacgacgaaacgtctaagtgtaagggg

SEQ ID NO: 329191 - DNA, 574 bp, Homo sapiens
  misc_feature: GZ8MTXP02HR3U1.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaagagccaccctctcctgcagggccagtcagagtgttagcagcgtacttagcctggtaccagcagaaacctggaccaggcctcccgaggcctcctcatctatgatcgacactaccaacgaacgggcccacgtgaactacctaccccagcccgtaggtttccaggttcggacgtagggttcggggtctgggggacaggtacgttccacttcctacacccatcacgcacggcctgactagttctagtaagttagtttcgaactttaaattttattacgttgtacagtactaagtaataactacgtcgtaccttacgtacttacgtttcggaccgagggaccaggtcgagaacactacaaaacgtgtcggtgactcgactacgta

SEQ ID NO: 329192 - DNA, 580 bp, Homo sapiens
  misc_feature: GZ8MTXP02F4CR1.51.76.G10.1.454.CMB.2.raw
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
  modified_base (510)..(510): a, c, t, g, unknown or other
  misc_feature (510)..(510): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggccccgggaggtccctgagactctcctgtgcagcctctggattcaccttcagtgcctatcggcatgcacgtggggtcccnccaggcctccgaggcgaaggggctgggaggtggggtggctatttatatcagatgatgganaagttaaanagatatggacagtcgtcgtagaacggggctactacaccattcaccagtanaaccaacttacccgaaanaaaccactactagtatcagaactaaagtagaaanagtagttagaagacgtacgtacggaacggacgtacggtnttacgttacgtttactttcgtaggtaacgaacgtaaacgtcgttaaggtaggtaagggttaggggtaagg

SEQ ID NO: 329193 - DNA, 494 bp, Homo sapiens
  misc_feature: GZ8MTXP02FZ970.51.76.G10.1.454.CMB.2.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggtagcgtggtccagcccggaggtccctgagactctcctgtgcagcctctggattcaccttcagtgcctatggcatgcactgggtccnccaggctccgaggcaaggggctggagtgggtgcatttanatcagatgatggcagtaanaaagngtatgcagtctcgngaaggcgattcacatctcagagacaattaccccagaacacactgtaactcagacaaatgaacaagatagagagatagaggacgacgcgtacgtgttattgtgtgtacgaacgactagtagtagg

SEQ ID NO: 329194 - DNA, 563 bp, Homo sapiens
  misc_feature: GZ8MTXP02I96OC.51.76.G10.1.454.CMB.2.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (454)..(454): a, c, t, g, unknown or other
  misc_feature (454)..(454): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggattccaccttnagtcgcctagtggcatgcacgtgggtcccncagggcctccgaggccgaaggggctgggagtggggtgctatttanatcagtntgatggactaagtaataaggntatgcagtcgtcgtagaaaccgggtctattcactatctacagacactactacccaagaaccactatagtatctagaactaanagtaacagtattaggagacgtctagggaacgacgaacgggttcttacgttacgttacttcggagtaacgtaacgtaacgtacgtaggtacggtagggttacgggtaagg

SEQ ID NO: 329195 - DNA, 568 bp, Homo sapiens
  misc_feature: GZ8MTXP02FY4AX.51.76.G10.1.454.CMB.2.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
  modified_base (468)..(468): a, c, t, g, unknown or other
  misc_feature (468)..(468): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagctctcctgtncagcctctggacttcaccttcagtgcctatggcatgctacgtcgggcccnccaggcctccgagggccgaaggggctgggaggtgggtgctatttanatcagatgatggacaagtaaatagngtangactagtcgtcggtaggaacgggcctattccaacctntctaccagaacactaactacccaagaaaccacactacgtactctagaacaaagtagaanagtatgaagacgacgtagacggacgacggtcttaggttacgtttattcgtagtaacggaccgtaaacgtcgtaggtacggtaggggttagggtaaagggg

SEQ ID NO: 329196 - DNA, 526 bp, Homo sapiens
  misc_feature: GZ8MTXP02JA19K.51.76.G10.1.454.CMB.2.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgcacgtgggtccnccaggctccgaggccaaggggctgggagtggggtgcagtttanatcagatgatggactaagtaanaagngtaatgacagttctccggtaggaacgggccgtatccgacatctaccagagacaacttcccaagaacacatgtatctagacaaagtcgaanagatgacgagactggagacacggntgtcgtatttcgngtaagacgaaacgtcgtagtcggaggtaggttaagggg

SEQ ID NO: 329197 - DNA, 516 bp, Homo sapiens
  misc_feature: GZ8MTXP02GPOBX.51.76.G10.1.454.CMB.2.raw
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagagccagggcagtctccanaggtcctgatctattgagtctagtccccggggcccccgggtcctgacnggttcagtggcagtgatcaggcacagtattttanactagaaaatcagcagagtggagctaggaggtatggttgggttatcgtattgcagtgacaagctactaactaaactccctatacgtacgtttcggacgggaacggaccgtaagggcggtaagacgtacgaaggacgaacgtgtagg

SEQ ID NO: 329198 - DNA, 553 bp, Homo sapiens
  misc_feature: GZ8MTXP02JD5EO.51.76.G10.1.454.CMB.2.raw
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcctgcatagtattggatacaacttattggattggcacctgcagaagccagggcagtctccactaggtcctgattcttaagtttgagttctaacgtccccggggacccccggggtcctgactaggttccagtggcaggtgatcgaggcactagtattttanaactagaaaatcgagcaaggagtggaggntaggaggtagttgggtttacggggttatacggtattggctagtgacaatctactaacaaactcctacgtacgtaacgtttcggacgggtaacggaccgtaagggtggaagacgtacgaagccgtaaacgtgtacgg

SEQ ID NO: 329199 - DNA, 518 bp, Homo sapiens
  misc_feature: GZ8MTXP02HQ43F.51.76.G10.1.454.CMB.2.raw
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttcagtgcctatggcatgcacgtcggggtccgccgaggcctccgaggcgaaggggctgggagtggggtgctatttatatcagntgatcggatagtaaataaagagtatgcagtctcgtgaaggcatcacatcacaganacaactaccagaacactagtntatctagacaaatgaaacagtatagagagcgtagacggacgtacggcgtagtgttattcgtaggtacggacgaaacgtcgtaggtaggtaggg

SEQ ID NO: 329200 - DNA, 526 bp, Homo sapiens
  misc_feature: GZ8MTXP02F84Y6.51.76.G10.1.454.CMB.2.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacaagggcccatgatactcccagccaggttcagtggcagtgggtctggggacaggagttccactctacaccatcagcagcctgcagtctagaagtatttgacttaatttattacttgtactagtactaagtataatacgtcggtcctacgtactacgtttcggaccgtaggggactacgacgtcggtagagtacgaaacgaacgtacgtaggtcgtacgtaccgactac

SEQ ID NO: 329201 - DNA, 540 bp, Homo sapiens
  misc_feature: GZ8MTXP02HC40H.51.76.G10.1.454.CMB.2.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctctggattcaccttcagtgcctatggcatgccacgtcgggtccgccgaggcctccgaggccaagggggctggggagtggggngtcagttttaanactgagatgagtggactagtaaataaagngtangactacgtcgtacgagaacggcatacacatccacagacacaactaccaagaacactactagtactcgtacgacaanacgaacagagtagagacgngtagacggacgacggtcgtacgttagttacttcgtagtacggacgaacgtcgtaggtaggtaggg

SEQ ID NO: 329202 - DNA, 540 bp, Homo sapiens
  misc_feature: GZ8MTXP02I48WE.51.76.G10.1.454.CMB.2.raw
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (456)..(456): a, c, t, g, unknown or other
  misc_feature (456)..(456): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccaggcccgggagtccctgacgactctcctgtgcagcctctggattcaccttcagtgcctatggcatgcacgtcgggtcccgcgaggcctccgaggcgaaggggctgggagtggggtgactagtttanactcagatgatggacagtaaataaagagtatgcagtctcgngaacggcatccactatctacagacacaactaccaagaaccacactagtatctagaacaaatacgaaanagtaatagagtagacgtaggacggaactacggcgttagttacgttattcgtggtacgacgtaaaacgtcttaagaggtaagggg

SEQ ID NO: 329203 - DNA, 521 bp, Homo sapiens
  misc_feature: GZ8MTXP02GWW19.51.76.G10.1.454.CMB.2.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattccaccttcagtgcctatggcatcgcacgtgggtcccgccaggcctaccaggccgaaggggctgggaggtgggtgctatttanatcagatgatggactagtaaataaagngtatgacagtctaccgtagaacggcgattcacatccacagagacaacttacccaagaaacacatgtatctagacaatagaacagtatagagagctaggacgacgtacggactgtagttatcgtgtacgacgaacgtctaagtggtaaggg

SEQ ID NO: 329204 - DNA, 504 bp, Homo sapiens
  misc_feature: GZ8MTXP02FPLNB.51.76.G10.1.454.CMB.2.raw
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggcccatgatanccagccaggttcagtgcagtggtctgggacagtagttcactctcaccatcagcagcctgcagtctagatatttgactaatttatactgtcagcagtataataacgtgccttcgtactacgtttcggaccgtaggggaccaagtcgtaggacgactacgaaaacgtaacgtgtcggctcgaccactacg

SEQ ID NO: 329205 - DNA, 681 bp, Homo sapiens
  misc_feature: GZ8MTXP02G3VXI.51.76.G10.1.454.CMB.2.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctcctgtgcagcctcgnggacttcaccttnagtcgcctagtggcatgcctacgtcggggtcccgccagggtcctaccgagggcgaagggggctaggggagggttggggtgactagttttanagtacagtatggtatgggactaaggttaaaataggacgttatgacctagttccgtaccgggtagggaaacggggtcctaacttaccaaccctacttacccgtacccgaagtaaacgtaaaccctaaaccgttacccccgaaacgtaaaacccaccttaaacgttacggtttaactacccgttaggaaaccttaaaacgtaaggaaaccgtaagttacgttaggaagtacgacggtacggaacggacgtacggtacgttggttagtttacttgttacgaacgacgtaaacgtcgtagtagggtagggtaggggttaaggg

SEQ ID NO: 329206 - DNA, 531 bp, Homo sapiens
  misc_feature: GZ8MTXP02GZ1T6.51.76.G10.1.454.CMB.2.raw
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtcgcctatggcatgcacgtcgggtccgccaggctccgaggcgaaggggctgggagtggggtgctagtttaactcagatgatggacagtaaanaaagngtatgctagtctcgtagaaggcatcacatcacaganacaattaccagaaacacactagtactctagactaaatgaaacagtaattgagaacgcgtaggacggacgaacggtctcgttaggttactttaagtggtacgacgaaaccgtctagtaggtaagggg

SEQ ID NO: 329207 - DNA, 549 bp, Homo sapiens
  misc_feature: GZ8MTXP02IRFII.51.76.G10.1.454.CMB.2.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtctgggggagcgtggtccagcccgggagtccctgagactctcctgtgcagcctctggattcaccttnagtncctatggcatcgcacgtgggtcccaccaggtcctccgaggccgaaggggtctgggaggtggggtcgactaatttanactcaagtatgatcggactaagtaaatagntatcgactagtctcgtagacggctatcacatcgtacagagacaactaccacaacaacactatatctanacaactagaactagtagtagtagagacgtacgacggacgacggtacgtacgttacgttacgttacgttagtaacgtacgtaacgtacgtagtacgtacggtagggtagg

SEQ ID NO: 329208 - DNA, 611 bp, Homo sapiens
  misc_feature: GZ8MTXP02IAAOL.51.76.G10.1.454.CMB.2.raw
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtctccactctccctgccccgtcacccgtggagagcccggcctccatcctcctgctaggtctagtcagacgcctcctgctattagtattggatacaacttagttggattggccacgtgacagaagcccgagggcagtcctccacgtacggtcctagtacttcttaagtttgaacgtttcgtaacggtcccccgggggtcccccccggggttcctggaaccgtaggtttccgaggttcggactaggtgactcgacggcacgtagtatttataactagaaaactcgaagcgagtaggtggagngtaggaggttagttggggtttgggtttaancgttagttgactagtagactaacgtctaactaactaacttccgttacgttacggttaccggttacggggacgggtacggtaacgagggtaacggagaacgtacgaacgaccgtagtcggcg

SEQ ID NO: 329209 - DNA, 605 bp, Homo sapiens
  misc_feature: GZ8MTXP02HR63G.51.76.G10.1.454.CMB.2.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcccgggagtccctgagctctcctgtgcagcctctggattcaccttcagtcgcctatggcatgcacgtcgggtcccnccgaggctccgaggccgaggggctgggaggtgggtgctatttanatcagatgatcggataagtaaatagngtaatgacctagtctacggtggaacgggtccattcaccatctaccaganaacctaactaccccgaaanaaaccactacttacgttactctaagaactaaagtacgaaactagtacgtaggaagacgtacgtaggaacggtaccgacggttacgttaggttacgtttacgtttacgtggtaacggtaaaccggtaaacgttacgtaaggttacgggtaaggggtttagggggtaaagggg

SEQ ID NO: 329210 - DNA, 527 bp, Homo sapiens
  misc_feature: GZ8MTXP02HHN0E.51.76.G10.1.454.CMB.2.raw
  modified_base (293)..(293): a, c, t, g, unknown or other
  misc_feature (293)..(293): n is a, c, g, or t
  modified_base (341)..(341): a, c, t, g, unknown or other
  misc_feature (341)..(341): n is a, c, g, or t
  modified_base (457)..(457): a, c, t, g, unknown or other
  misc_feature (457)..(457): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcacgtgggccncaggcctccgaggcaaggggctgggagtggggtgctatttagatcagntagatcggatagtaaataaaggcgtaatgctagttcgtaccggtagaacggggccgtaattccaaccattccaccaagacgaacaacttacccaagtaaaccactactgtactacngacaaatcgaaactagattagagtagcgtgaagcacggtctgtntntgngtacgacgagtctagtggagg

SEQ ID NO: 329211 - DNA, 561 bp, Homo sapiens
  misc_feature: GZ8MTXP02HRRSU.51.76.G10.1.454.CMB.2.raw
  modified_base (437)..(437): a, c, t, g, unknown or other
  misc_feature (437)..(437): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagacgcctcctgcatagtattggatacaacttattggattggcacctgcaagagccgagggcagtcctccacgacggttcctgtattcttatttgagtttcctaacggttcccccggggaccccccggggtcctggaccgtagggtttccagggttcggcgtaggtggatcgaggcaacgtagttatttatactagaaatcgagacagaggtggagtntaggaggtagtgggttttgggttatcgtattggctatgacgagtcctactaactaaactctatacgttacgttacgggacggaggtaccgaggtaaggagacgtacgaagacgaacgttgacgg

SEQ ID NO: 329212 - DNA, 520 bp, Homo sapiens
  misc_feature: GZ8MTXP02HW1GX.51.76.G10.1.454.CMB.2.raw
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcacgtgggtcccnccgagggcctccgaggcgaaggggctgggagtggggtgctagtttanatcagatgatggacaagtaatagngtatgcagtctcgtagaggcatcacatctcagagacactacccagaacacactgtatctagacaaatcgaaanagtattagagaagcgtagaacggtacacggcgttgtcgttattcgtagtcgacgaaacgtctagtcggaggttaggggtaaggg

SEQ ID NO: 329213 - DNA, 522 bp, Homo sapiens
  misc_feature: GZ8MTXP02GNO73.51.76.G10.1.454.CMB.2.raw
  modified_base (287)..(287): a, c, t, g, unknown or other
  misc_feature (287)..(287): n is a, c, g, or t
  modified_base (402)..(402): a, c, t, g, unknown or other
  misc_feature (402)..(402): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctctgcatagtattggatacaactatttggattggcacctgcagagccagggcagtctccanaggtcctgatctattgagttctaagccccggggcccccgggtcctgacctaggttcagtggcagtggatcaggcacagtatttatactagaaaatcgaagcgaagagtagggagngttagaggtagttggtttggggtttatctagttgctagtgacaagctactaacaactcctatacgtaccgttggacggtacggaaccaagggtgganagtacgaagacgaacgtgtacgg

SEQ ID NO: 329214 - DNA, 581 bp, Homo sapiens
  misc_feature: GZ8MTXP02GE7EN.51.76.G10.1.454.CMB.2.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtctgggggaggcgtggtcagccgggaggtccgtgagctctcctgtgcncgctctgtntctctcngtgctntgnangcncgtcggtccgcgacgctcgacggcgaggngtggtggtggtggtgtattatagtagagagtgtagtaggacgtaaagtaaaagtaagtaagtagtacgacgtacgtcgtacggtacggaacgggtacgtacgtacctactactctacgacgaacgaactaactacctaacgaaactaactactacgtactactacgaacaaagtaacgaacgtaagtagtagagagacgtacgacggacgtacgtacgtacgttacgttacgttacgtagtaacgtacgtaacgtacgtagtaggtagggtaggtaggg

SEQ ID NO: 329215 - DNA, 633 bp, Homo sapiens
  misc_feature: GZ8MTXP02HEIOK.51.76.G10.1.454.CMB.2.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggacttcaccttcagtcgcctatggcatgcacgtggggtcccnccagggcctccgaggcgaaggggctggggagtggggtgctatttanatcagatgatggactaagtaaataaggngtatgactagtctaccgggtaggaaacggggccctaacgttccgaacctacgttaccctaccgaagaacgaacctaaaccttaccccgaaagaaaccaactaacctagtaactactagaacctaaagtaggaaacagtagttaggaagtagaccgtaggaacggaccgtaacgggtcttacggttagttaactttcgtacggtaacggtaaccgtaaaacgtcgttaaaggtcgggtaacgggttagggggttaaagggg

SEQ ID NO: 329216 - DNA, 683 bp, Homo sapiens
  misc_feature: GZ8MTXP02IUXT0.51.76.G10.1.454.CMB.2.raw
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagcccgggaggtccctgagactctcctgtgcagcctctgattcacttcagtgcctatggcatgcacgtcgggtccnccaggcctcgaggcgaggggctgggagtggggtgctagtttanatcgagtatgatggacaaggttaaataggtgtatgctagtcgtacggtaggaacggcctattcgaacctattccgacctaagaacgtaactaaaccttacccgaagtaaaaccaccgttacttacggttactaccgttagaaaacctaaaagttacggaaacgtaaaggtaacgtttaacgggaaagtacgtacgttaaacggggaacgggtaaaacccgtccgggggtttactttacgggtttacgtttaacggttttcggtaacgggttaaccggtaaaacccggtaaaacggttcggttaaagggtttacggggtaacgggggtttaagggggtttaaagggg

SEQ ID NO: 329217 - DNA, 597 bp, Homo sapiens
  misc_feature: GZ8MTXP02JO9XQ.51.76.G10.1.454.CMB.2.raw
  modified_base (345)..(345): a, c, t, g, unknown or other
  misc_feature (345)..(345): n is a, c, g, or t
  modified_base (518)..(518): a, c, t, g, unknown or other
  misc_feature (518)..(518): n is a, c, g, or t
  modified_base (536)..(536): a, c, t, g, unknown or other
  misc_feature (536)..(536): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattccaccttcagtcgcctatggcatgccacgtcgggtccgccaggcctccgaggcgaaggggctgggagtggggtgctagtttanatcagatcggatgggacaggtaaataaaaggagtaacgtgacgtagttcccgtaccggtaggaaacggggtcccgtattcccaaaccctatccctacccgaaggaacacctaaacttaccccgaagaaaccactaacttgtactcgtagacaaattgaaactagtagtagaanacggctaggacggaaacncgggccttaggttacgttatttcgtagtacggtacgaaaacgtcgttaagtaggtaagggg

SEQ ID NO: 329218 - DNA, 603 bp, Homo sapiens
  misc_feature: GZ8MTXP02F15BH.51.76.G10.1.454.CMB.2.raw
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (275)..(276): a, c, t, g, unknown or other
  misc_feature (275)..(276): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtcgtgggggaggcgtggtccgagcccgggcggtcccgtgagactctcctgtgcngctcgtgtntctctcngtcgctgtgnntgcgcgtcggtccgcgngcgcgagngaggngnggnggtggtgtntatatatgagagtgtagtgagtaagtaaagtaagtaagtagtagtacgtacgtacgtacggtacggtaacggtacgtacgtacgtacgtacgtacgtaccgacgtaacgtaacgtaaccgtaaccgaacgtaaactaacctacgtacgtactacgtacgtaacgtaaacgtaagaacgtaagtagtagtagacgtacgtacggtacggacgtacgtacgttacgttacgttacgttacgtacgtaacgtacgtaacgtacgtagtacggtaggtaggtaaggg

SEQ ID NO: 329219 - DNA, 626 bp, Homo sapiens
  misc_feature: GZ8MTXP02JK4SJ.51.76.G10.1.454.CMB.2.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (603)..(603): a, c, t, g, unknown or other
  misc_feature (603)..(603): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattccaccttcagtcgcctatggcatgcacgtcggggtcccnccagggccctccgagggccgaagggggctgggaggtggggtggctaatttanatcaagtntgagtggacaagttaaataaggagtatcgatagtccgtaccggaggaaacggggccctaattcccaacctagttccctaccgagaacgtaactaaaccttccccgaaagtaaccaacctacgttagtaactctaggaaacctaaatacgaacaagtattaggaagtacgacgtaggacggacgtacggcgtttaggttacgttacgtttcgtaggtccgaacggtaaacgtcgtaagttacggnggggttaggggtttaaacggggg

SEQ ID NO: 329220 - DNA, 612 bp, Homo sapiens
  misc_feature: GZ8MTXP02JAK98.51.76.G10.1.454.CMB.2.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtcccaggcccggggaggtccctgagctctcctgtgcagccctntggattcaccttcagtgcctanggcatgcacgtgggtcccgcagggcctccgaggcgaaagggggtctaggggacgtggggtggctatttanatcaagatgaatgggacaagtaaataagngtaatgactagtctccgtaggaacgggccagttccaaccattccaccaggtaacgactaacttccccaaagtaaaccactaactagtactctagaactaaanagaacagtagttacgaaggtagtacgtaggaaacggacgtaacggtcgttacggttagttacgtttaccgtaggttaaccggacggtaaaaccggtcgttaagtacgggttaaggtagggggttaaacgggg

SEQ ID NO: 329221 - DNA, 543 bp, Homo sapiens
  misc_feature: GZ8MTXP02J2DR8.51.76.G10.1.454.CMB.2.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccccgggaggtccctgagactctcctgtgcagcctctggattcaccttcagtgcctatggcatgcacgtgggtcccgccaggcctccgagggcgaaggggctgggagtggggngctagtttanatcagatgatggacagtaaataaagngttancgctagtctaccgtagaaggccgtatcacatcacagacactaactccgaanaaccacgactgtactctagacaaatgaacagtatagagacgcgtaggaacggtaccgacggtctaggttagtttacgttcgtaggtacgacgtaaaccgctttaggcggtaagggg

SEQ ID NO: 329222 - DNA, 558 bp, Homo sapiens
  misc_feature: GZ8MTXP02HUS0O.51.76.G10.1.454.CMB.2.raw
  modified_base (345)..(345): a, c, t, g, unknown or other
  misc_feature (345)..(345): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggtccaggcccgggagtccctgagactctcctgtgcagcctctggattccaccttcagtcgacctatggcagtgcacgtgggtccgccaggcctccgaggccgaaggggctgggagtgggtgctagtttanactcgagatgagtggactagtaaataaagagtacgtgcagtcctaccgtaggaaacgggtcctattccaacctatcctaccagaacgactaacttaccccaaagaaaccactactagtaactccgtagacctaaaatcgaaactaggtatagagtagcgtaggacgacgacgctgtagttagttcgtgacgacgtaaacgtctagtagtaggg

SEQ ID NO: 329223 - DNA, 609 bp, Homo sapiens
  misc_feature: GZ8MTXP02F5P2L.51.76.G10.1.454.CMB.2.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagctctcctgtgcagcctctggattccaccttnagtgcctagtggcatcgcacgtgggtcccnccaggctccgaggccgaaggggctgggaggtggggtgtctagtttanatcagatgatggacaagttaaatagntatgctagtcgtaccggtagaacgggctattccactactctaccagtacaactaaccttacccaaagaaaccactacgttagtactcgtacgaactaaaacgtgaaacagtaagttagaagtagacgtaggaacggaacgaccggtgttacggttagtttaacgtttccgtaggtaacggtaaacccgtaaacggttactaaggtagggtaaggggtttagggggtttaaacggggg

SEQ ID NO: 329224 - DNA, 532 bp, Homo sapiens
  misc_feature: GZ8MTXP02I4PLD.51.76.G10.1.454.CMB.2.raw
  modified_base (429)..(429): a, c, t, g, unknown or other
  misc_feature (429)..(429): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatcctcctgcaggtctagtcagagcctcctgcatagtattggatacaactattggattgcactgcagaagccagggcagtctcacaggtcctgatctattgattctaatcccggggcccccgggtcctgactaggttcagtggcagtggatcgaggcacagtatttatactagaaatcagcaaggagtggaggctgaggtattgggtttaggggttatcgtattcgntagtgacaagtctactaactaaaacttcctataacgtacgtttacgggcggtaaacgggaccgtaagggtaacggagacgtacgaaggacgaacgtggtacgg

SEQ ID NO: 329225 - DNA, 625 bp, Homo sapiens
  misc_feature: GZ8MTXP02HJG0H.51.76.G10.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagccctntggattcaccttcagtgcctatggcatgcatggggtccccncgagccncgaggacgaaggggtctaggggaggttggggtcgtacttaatttagtactacgaagagtagagtaggactaaagtaaagtaagngtatcgacgtacgtccgtacgaggaacgacctaattaccaaccataccctaccaagaacgtaaaccaactacccgaaacgaaacctactaacgttagtactactacgaacaaagtaacgtaaagtaagtaagtagtaacgagacgtacggaacggacgacggtacgttacgttacgttacgttacgttacgtaacggtaacgtaaacgtacgtagtaggtacgggtaaggggtaaggg

SEQ ID NO: 329226 - DNA, 544 bp, Homo sapiens
  misc_feature: GZ8MTXP02JUAGZ.51.76.G10.1.454.CMB.2.raw
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (527)..(527): a, c, t, g, unknown or other
  misc_feature (527)..(527): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagnggtgtccagtgtcaggtncagctggtggagtcgtgggggagcgtggtccaggcccgggaggtccctggacgactctcctgtgcagcctntggattccaccttnagtgcctagtcggcatgcacgtcgggccnccaggcctcgaggcgaaggggctgggagtgggngactatttantcagntagntggacagtaaataaaggctangactagtcacgtagacggcctatccgaccntccacgagacactactaccagaacactatgtacncgtanaactaaatgaaacgtgtagtgagacgacgtagggacgaccgtaggtactggttatttagttcgtagttacggaacgttaacgntttaggagttaaggggg

SEQ ID NO: 329227 - DNA, 557 bp, Homo sapiens
  misc_feature: GZ8MTXP02IRWRJ.51.76.G10.1.454.CMB.2.raw
  modified_base (254)..(254): a, c, t, g, unknown or other
  misc_feature (254)..(254): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccngcagaaacctggccaggctcccaggcctcctcatctatgatgcatccacgaagggccactgatactcccagccaggttcagtggcaggtgggtctggggacaggtacgttcactctactaccatcagcacgcctgctagtcgtagtaagtattttagacttaaattttattacttgtacagtactagttaacttaaatacgtcggtacctacgttactcgtttacggacccgtagggggacctaaggcgttacgggaagtaacaacgtaaacgtaacgtggtacggccttacggacctactac

SEQ ID NO: 329228 - DNA, 579 bp, Homo sapiens
  misc_feature: GZ8MTXP02HEUSL.51.76.G10.1.454.CMB.2.raw
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcacgtgggtcccaccgaggcctccgaggcgaaggggctgggagtggggtgctatttanatcagatgatggacaagtaataagngtatgactgtctcggtagaagggcattcacatctcagagacaatcccaagaacacactgtatctagacaaagtacgaaactagattagaagagacgttaggaacgggaaccgtacggggaccttagggttagtttaacgtttccgttaggttaacggaaccggtaaaaccggtcgttaaggtacggggtacgggttaagggggttaaaggggg

SEQ ID NO: 329229 - DNA, 549 bp, Homo sapiens
  misc_feature: GZ8MTXP02HAG5M.51.76.G10.1.454.CMB.2.raw
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggccccgggaggtccctgagactctcctgtgcagcctctggattccaccttcagtgcctatggcatgcacgtggggtccnccaggcctccgaggccgaaggggctgggagtggggtgctatttanatcagatgatggacagtaataaagngtatgacagtcctcgtagacgggcctattcacctatcctaccaagtacgactaacttacccaagaaaccactactgtactacgtagacaaagtacgaaanagtatagagacgacgaggacgacgacggtcgtagttagttagttcgtaggtacgacgtaacgtcgtaggtaggtaggg

SEQ ID NO: 329230 - DNA, 569 bp, Homo sapiens
  misc_feature: GZ8MTXP02F1IH4.51.76.G10.1.454.CMB.2.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttagcagcgacttagcctggtaccagcaagaaacctggccaggcctcccaggcctcctcatctatgatgcactccaacgaacggcccactgactactcccagcctaggttcagtggcgtaggtgggtctggggacaggtagttccactctacaccatcagcacgcctgctagtctagtaagtatttgacttaatttacttactgtacagtactaagttaataactacgtcgtaccctacgtacgttacgtttacggaccggtaaggggacctaaaggtcgtaggaacgacttaaacggaaaacgtaacgttggtacggtactcggaacctaccgtttacg

SEQ ID NO: 329231 - DNA, 630 bp, Homo sapiens
  misc_feature: GZ8MTXP02IE32W.51.76.G10.1.454.CMB.2.raw
  modified_base (168)..(168): a, c, t, g, unknown or other
  misc_feature (168)..(168): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtggtttctcgtagctctttaagaggtntcagtgtcaggtgcagctggtggagtcgtgggggaggcgtggtccaggcccgggtaggtccctgagctctctgtcgcagcctctggtatctccttcntgcctatggcntcgcgtcgtcggtccgccgacgcgtcgacggacggagggcggtggtagggtgggtggtacgtagttagtagtacgtagtagtagtagtagtagtaaagtaaagtaagtaagtagtacgtacgtacgtacggtacggtacggtacggtaccgtactacctactactaccgtacgaacgaacgtaacgtaaccgtaccgaacgaaactaactacgtacgtacgtacgtacgtaacgtaaacgtaacgtaacgtaagtagtagagacgtacgtacggacgacgtacgtacgttacgttacgttacgttcgtacgtaacgtaacgtaacgtacgtagtacggtagggtagggtaaggg

SEQ ID NO: 329232 - DNA, 654 bp, Homo sapiens
  misc_feature: GZ8MTXP02G2NIU.51.76.G10.1.454.CMB.2.raw
  modified_base (433)..(433): a, c, t, g, unknown or other
  misc_feature (433)..(433): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctcgcccgtcacccctggagacgccggcctccatcctcctgcaggtctagtcagacgcctcctgcatagtattggatacaacttatttggatttggcaccgtgacagaacgccgagggcagtcctaccacgtaggtcctagtattcttagtttagtacgttaccgtaacggtccccccgggggtaccccccggggttcctaggaccgtcggttacgaggtcgggactaggttggactcggaggactacgtagttattttanaactagaaaatcgaagacgaggtaagggtggagggtacgtagggaggttagtttggggtttaccgggtttatacgttagttagacgtagttcggaactaacgtaccttactaaaacctaaccttacccgttagttaacggttaccggtttaccgggtacggggaaaccggtaaccgtaagggtaaggaacgtaagtacggaacgacggtaacgtaggtcgg

SEQ ID NO: 329233 - DNA, 603 bp, Homo sapiens
  misc_feature: GZ8MTXP02HISGA.51.76.G10.1.454.CMB.2.raw
  modified_base (245)..(245): a, c, t, g, unknown or other
  misc_feature (245)..(245): n is a, c, g, or t
  modified_base (338)..(338): a, c, t, g, unknown or other
  misc_feature (338)..(338): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctcgcccgtccaccctggagagccggcctccatctcctgcaggtctagtcagagcctcctgcatagtattgganacaactattggattgcacctgcagaagccagggcagtctccacaggtcctgatctaatttgagttctaaatcccggggcccccggggtccctnacgtaggttcaggtggcgacgtaggagtacgacgacgacgaagtaagttaattaactaacgtaaaagtaaactaagacgtaagaaggtagggaggtaggtaggtaggtaaggttaggtttaggggtttaaggttacgttagttagtacgtagtagtacgtaacgtacgtactaactaaaacttaacctacctaacgtaacgttacggtacggtacggaacggaacggtaaggtaacggaacgtacgaacgacgaacgtacgtacg

SEQ ID NO: 329234 - DNA, 581 bp, Homo sapiens
  misc_feature: GZ8MTXP02GRMQZ.51.76.G10.1.454.CMB.2.raw
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagcgcctcctgcatagtattggatacactattggattggcactgcagagccagggcagtctaccagtaggtcctgatcgttaatttgagttcgtaacggtcccccggggtcccccggggtcctggactaggttcaggtgcgaggtggatcgaagcatagtattttanactaagaaaatcagcagtaggtaggaggngtaggaggtagttagggtttaggttatacgttagttcgngtagtacgaactaacgtacctaactaacctaaccttcgtaacgtacgttacggttacggggacgggtaacgggaacggtaagggtaagaacgtaacgtacgaaaggtaccgtaacgtcggtacgg

SEQ ID NO: 329235 - DNA, 530 bp, Homo sapiens
  misc_feature: GZ8MTXP02GZCVK.51.76.G10.1.454.CMB.2.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctagtggcatgcacgtgggtccnccaggctccgaggcaaggggctgggagtggggngctagtttanatcagatgatcgganaaggtaatagngtactgcagtcncgngaaggcatcacatcacngacactaatcccgaaanacacactgtactctagaacaagtaagaacagtagtagagagacgacgacgacgacgtacgtacgtacgttacgttcgtagtaagacgaacgtacgtagtaggtaggtagggtagg

SEQ ID NO: 329236 - DNA, 539 bp, Homo sapiens
  misc_feature: GZ8MTXP02F23H1.51.76.G10.1.454.CMB.2.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacaggggggagaggagcccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccnccaggctccaggcaaggggctgggagtggggtggctagtttanatcagatgatggacagtaaataagngtatgcagtctcgtgaagggccattcacatctcagagacaacttcccagaacacactgtactctgacaaagtgaacagattagagagcgtaggacggacgacggtctaggtacgttagtttcgtgttacgaacggtaaaacgcgttagtaggtaggtacgggggtaggtttaaaggggg

SEQ ID NO: 329237 - DNA, 542 bp, Homo sapiens
  misc_feature: GZ8MTXP02I9ZM2.51.76.G10.1.454.CMB.2.raw
  modified_base (188)..(188): a, c, t, g, unknown or other
  misc_feature (188)..(188): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggagtccctgagctctcctgtgcagcctcgtggattcaccttcagtgcctagtggcatgcacgtgggtccncaggctccaggcaaggggctggagtgggngctagtttanctnagatgagtgatagtaaataagagtangactagtcgtacgagacggctatcactactcacagacacaactaccaagaacactactagtactacgtagaactaaagtacgaaacagtaagtagaagtacgtagtacggaacggtacgacggtacgttaggttgttagttcgtcgtacggtaacgaacgtcgtaaggtacggtagg

SEQ ID NO: 329238 - DNA, 548 bp, Homo sapiens
  misc_feature: GZ8MTXP02GIWQX.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcctgcatagtattggatacaactattggattggcacctgcagaagccagggcagtctccacaggtcctgatcttatttgagttctaacgtccccggggcccccgggtcctgactggttcagtggcaggtggatcgaggcacgtagtatttaatactaagaaaatcgaagcagagtgggagcgtaggaggtagttggtttaggggttatacgtattgctagtgactagtctactaactaactcctagtacgtaccgtttacggacggtaacgggaccgaagggtaaggacgtaacgtaccgaaaggacgtaacgtggtcgg

SEQ ID NO: 329239 - DNA, 568 bp, Homo sapiens
  misc_feature: GZ8MTXP02JL3RQ.51.76.G10.1.454.CMB.2.raw
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (525)..(525): a, c, t, g, unknown or other
  misc_feature (525)..(525): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctcctgtgcagcctntggattccaccttcagtcgcctatggcatgcacgtggtcccgcaggcctccgagggcaggggctgggaggtgggtgctatttanatcagntgatgggactaaagtaataagngtatgctagtccgtacggtaggaacgggcctaattcccaccgtacttccgtacaagaacgactaaacttcccaagtaaaccactactcgtatcctagaaccaaatgaaactagattagagagtctaggacggacacggtcgttgtcgttacgtttcgngtaacgacgaaacgtcgtaagtggtaaggtggggttaaagggg

SEQ ID NO: 329240 - DNA, 551 bp, Homo sapiens
  misc_feature: GZ8MTXP02FZK0H.51.76.G10.1.454.CMB.2.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcngcctctggattccaccttcagtgcctatggcatgccacgtggggtcccnccagggcctccgaggcgaaggggctgggaggtggggtggctagtttanatcagatgatggacaagtaaataagngtatgactagtctccgtaggaacggcgattcacatctccagacgactaactacccaagaaccacactagtatctagaactaaatagaacagtattgagagctaggagacgacggcttagtacgttattcgtaggtcggtaacgaaacggtctagtacggtaggttaggggtaaagggg

SEQ ID NO: 329241 - DNA, 589 bp, Homo sapiens
  misc_feature: GZ8MTXP02JTPHV.51.76.G10.1.454.CMB.2.raw
  modified_base (411)..(411): a, c, t, g, unknown or other
  misc_feature (411)..(411): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatcctcctgcaggtctagtcagacgcctcctgcatagtatggatacatattggattggcactgcagagccagggcagtctccagaggtcctgacttcttagtttgacgtttcctaaggtccccccggggccccccggggttcctaggtaccgtaggtttaccagggttcgggccaaggttggactcgaggacaacgtagtattttaanactagaaaatcgagcagaggtgggagtcgtaggaggtagttggggtttaggggttaatcgtatttcggactagttcggactaaggcctttaaccaactaaacctctaccgtaagtaccgtttacgggacggtacgggtaaccaagggtgacgtacgacgaaacgcgtaagtcggtacg

SEQ ID NO: 329242 - DNA, 522 bp, Homo sapiens
  misc_feature: GZ8MTXP02G57BQ.51.76.G10.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (378)..(379): a, c, t, g, unknown or other
  misc_feature (378)..(379): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctangatgcatccanaagggccactgatatcccagccaggttcagtggcagtgggtctggggacagtagttcactctcaccatcagcagccnncngtntgagtattatatatttattactgtntagactataataataacgtacgtacctaccgtactacgtttacggtacgacgggacgaacgacgtacgtacgaactaacgaaacgaacgtacgtacgacgtacgactactacg

SEQ ID NO: 329243 - DNA, 515 bp, Homo sapiens
  misc_feature: GZ8MTXP02FWAYU.51.76.G10.1.454.CMB.2.raw
  modified_base (254)..(254): a, c, t, g, unknown or other
  misc_feature (254)..(254): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (443)..(443): a, c, t, g, unknown or other
  misc_feature (443)..(443): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctntggattcaccttcagtgcctatggcatgcacgtgggtcccgccaggctccgaggcaaggggctgggagtggtggctatttanatcagatgagtggacaagtaatagntatgacagtctacgtagaaggccgatcaccatctcagacaactaatacccagaaacacactgtactctagacaaaagtgaanagatagagagacagagacgacgacgtagtgtattctagtgacgaacgtacgtagtagtaggtaggtaagggg

SEQ ID NO: 329244 - DNA, 501 bp, Homo sapiens
  misc_feature: GZ8MTXP02JZBTY.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccacccctctcctgcagggccagtcagagtgttagcagcgacttagcctggtaccagcagaacctggccaggctcccaggctcctcatctatgatgcatccacaagggccactgatatccccagccaggttcagtggcaggtgggtctggggacaggagttcactctcaccatcagcagcctgcagtctgaagtatttgactaatttattactgtcagcagtataataactgcctacgtactacgtttcggaccgtaggggaccaagcgtagacgagtacaacgaacgtgtaggctcgcacta

SEQ ID NO: 329245 - DNA, 553 bp, Homo sapiens
  misc_feature: GZ8MTXP02JBHOE.51.76.G10.1.454.CMB.2.raw
  modified_base (372)..(372): a, c, t, g, unknown or other
  misc_feature (372)..(372): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtatggatacaactattggattggcacctgcagagccagggcagtctccacaggtcctgatctatttgattctaacgtccccggggcccccgggtcctgacgtgttcagtggcaggtgatcgaggcacagtatttanactagaaatcgagacagagtggagcgtaggaggagttgggtttaggggtttatactagttgactgtgacgagtacttcgtaaactaaaccttccgtacttaacgtaccgtttacgggacgggtaacggggaacccgtaaggggtaaggaacgtacgtacgaaggtaccgaacgtggtacgg

SEQ ID NO: 329246 - DNA, 610 bp, Homo sapiens
  misc_feature: GZ8MTXP02FZ04U.51.76.G10.1.454.CMB.2.raw
  modified_base (296)..(296): a, c, t, g, unknown or other
  misc_feature (296)..(296): n is a, c, g, or t
  modified_base (553)..(553): a, c, t, g, unknown or other
  misc_feature (553)..(553): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattccaccttcagtgcctatggcatgcacgtgggccncaggctccgaggcgaaggggctgggaggtggggtggctagtttatatcgagtatgagtggactaaagttaaataaggagtaatgacaagttccgtaccgggtaggaacggggtccgtaacttacccgaactactcctacccgaagtacgaaacctaaacttaccccgaaagtaaaccaacctaaccgttaggtaacttcctacgaaactaaacgtagaaacgagtagttaggaagtagcgtaggacggacgacggtntagtcgttattcgtaggtaacgacgtaaacgtcgtagtaggtaggtagggtaagggg

SEQ ID NO: 329247 - DNA, 492 bp, Homo sapiens
  misc_feature: GZ8MTXP02FU4YS.51.76.G10.1.454.CMB.2.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggcccactgatatcccagccaggttcagtgcagtggctggggacagagttcactctcaccatcagcagcctgcagtctgaagtatttgactaatttattactgtcagacagtataataactggcctccgtacactttcgccgagggacagacgtaggagatacaaacgaactgtacggctcgacacta

SEQ ID NO: 329248 - DNA, 592 bp, Homo sapiens
  misc_feature: GZ8MTXP02HOI94.51.76.G10.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttagcagcgacttagcctggtaccagcaagaacctggccaggcctcccaggctcctnatctatgatgcatccacgaaggccactgatactcccagcctaggtcagtggctaggtcgggtctggggacaggtacgttcactctacaccatcagcacgctgcacgtctagtaagttatttgattaattttattacttagtactagtactagttaacttaactaacgttcggtacccttaccggttaacttaccggttttacggacccggtaagggggtaaaccctaaacgggtccgtagggtaacttaaacgtaaccgtaaaaccggtaacgttacggttacgggacctacggaacctaaccttacg

SEQ ID NO: 329249 - DNA, 581 bp, Homo sapiens
  misc_feature: GZ8MTXP02INDOV.51.76.G10.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctctgtgcagcctntggattcaccttcagtgcctatggcatgcacgtggggtcccnccgaggcctccgaggccgaaggggctgggagtgggtgctatttnatcagatgatggactaagttaaataaggtatatgacaggttctcggtaggaacgggcctagttcactatcctcagaacgactaactacccagaaaccacgtactgtactctagaaccaaagtgaaactagtattaggacgagcgtagacggacgacggtcttagttagttacgtttccgaggttaacggaaccggtaaacgtacgttaagtacgggtaagggttagggggtttaaaggggg

SEQ ID NO: 329250 - DNA, 635 bp, Homo sapiens
  misc_feature: GZ8MTXP02GAA6H.51.76.G10.1.454.CMB.2.raw
  modified_base (342)..(342): a, c, t, g, unknown or other
  misc_feature (342)..(342): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctctggattcaccttcagtgcctatggcatgcacgtgggtccgccagggcctccgaggccgaaggggctgggagtggggtggctagtttanatcgagtatgagtggactaaagttaaagtaggtagtagtgactacgtcgtacgggaggaacgggtcctataccaacctatccctaccgaagacaacctaaccgtacccgaagaaaccactacgtagttactacgtacgaaactaaagtacgaaactaaggtattacgggaagtacgtacgtacggaaacggtaccggtacgggtcgttaggtttacgtttacgtttcgtagggtaaccgtaaaccggtaaaacgttcgtaaggttacgggtaggggtttacgggggttaaggg

SEQ ID NO: 329251 - DNA, 522 bp, Homo sapiens
  misc_feature: GZ8MTXP02I0OKQ.51.76.G10.1.454.CMB.2.raw
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcactgggtccnccaggctccgaggcaaggggctggagtgggtgctatttanatcagtatgatggacaagtaataagngtactgacagtctcgtagaagggccattcaccatctcaganacaactcccagaaacacactagtatctagacaaatgaacagattgaagagctaggacgacacggtctagtacgttacttcgagtaacgaacgtaaacgtcgtagtaggtaggtagggtaagg

SEQ ID NO: 329252 - DNA, 641 bp, Homo sapiens
  misc_feature: GZ8MTXP02G53IB.51.76.G10.1.454.CMB.2.raw
  modified_base (365)..(365): a, c, t, g, unknown or other
  misc_feature (365)..(365): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagtcctctggacttccaccttcgagttcgcctagtcggcagtgccagtcgggtccgccgaggcctaccgaggcgaacgggggtctggggaggttggggtacggtctaatttttanagttacgaagtagtagaacgttggggactaaggttaaaagtaaaaggtaggttaatgaccgtagttcccgtaccgggttaggaaccggggtccctaattacccgaaccctactcccgtaacccgaggaaccgtaactaaccgttacccagtaaaccactacgttagtactctacgaactaaagtagaaacgagtagtacgaagtagacgtaggacgtacgtacggtcgtaggttcttagtcgtagtacgtacgaaacgtcgtaagtcggtaagggg

SEQ ID NO: 329253 - DNA, 540 bp, Homo sapiens
  misc_feature: GZ8MTXP02F6CXA.51.76.G10.1.454.CMB.2.raw
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccagcccgggagtccctgagactctcctgtgcagcctctggattcaccttcagtgcctagtggcatgcacgtgggtccnccaggctccgaggcgaaggggctggagtgggngctatttanactnagntgagtgatagtaaanaagatagtgactagtctacgtaggacggtctatcactatcacgagactactactaccgaanaacactacgtgtactacgtagaactaataacgaacgtaagtagtagagacgagtaggacggacgacgtacgtacgtagttagttcgtacgtacgtacgtaacgtacgtacgtaggtagg

SEQ ID NO: 329254 - DNA, 533 bp, Homo sapiens
  misc_feature: GZ8MTXP02G9CYL.51.76.G10.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctatctgtgtctccaggggaaanagccaccctntcctgcagggccagtcagagtgttagcagcgacttagcctggtaccagcagaacctggccaggctccaggctcctcatctatgatgcatccaacaagggcccatgatactcccagccaggttcagtggcaggtgggtctggggacaggagttcactcncaccatcagcagcctgcagtctagaagtatttgactaatttattactgtacagcaagtataaataactcggtaccttacgtactacgttttacggaccgtagggggaccaaaggcgtacgggagaacgtacgaaaacgtaacgtacggtggactacggaccaacctacg

SEQ ID NO: 329255 - DNA, 543 bp, Homo sapiens
  misc_feature: GZ8MTXP02GIKVJ.51.76.G10.1.454.CMB.2.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattcaccttcagtgcctanggcatgcactgggccncaggctccgaggccaaggggctggagtgggtgctatttanatcagatgatggacaagttaanaagntangcagtctcgagaggcatcacatcacagagacaactacccaagtaaaccactaactgtaactctacgaataaactagaaactaagtagttagagagagtacgaggacgacgtacgtcgttacgttagtttacgttacgtaacgtaacgtaaccgtacgtagtaggtaggtaggggttaaggggg

SEQ ID NO: 329256 - DNA, 563 bp, Homo sapiens
  misc_feature: GZ8MTXP02JH2HS.51.76.G10.1.454.CMB.2.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgctcttttaagaggtgtccagtgtcaggtncagctggtggagtcgtgggggagcgtggtccaggcccgggagtccctgagctctcctgtgcagcctctggattcaccttcagtgcctatgcatgccacgtgggccnccgaggctccgaggcgaaggggctgggaggtggggtgactagtttacagtcagatgatggactaggtaaataaaggagttacngacacgttccgtccggtaggaacggcgtataccacctatccacgaagacgaacaacttacccgaagtaacactactacgtactacctagactaaagtacggaaatagtaagtagagaagcgtaggacgacgaccggtcgtacgtgttattcgtaggtacgtacggaactctaaggtggtaacgggg

SEQ ID NO: 329257 - DNA, 522 bp, Homo sapiens
  misc_feature: GZ8MTXP02IQ28L.51.76.G10.1.454.CMB.2.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (444)..(444): a, c, t, g, unknown or other
  misc_feature (444)..(444): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggaggtccctgagactctcctgtgcagcctctggattcaccttcagtgcctatggcatgcacgtgggtccgccaggcctccgaggcgaaggggctggagtgggtgctatttanatcagatgatggcagtaataaagngtatgnagtctcgtgaaggccgattcactanctcagagacaattcccaagaaccacactgtatctagacaaatgaaacngtatcgagacgcgtaggacggacacgggtctaggtgttaatttcgtcggttacgacgaaccgtctagtaggtaagggg

SEQ ID NO: 329258 - DNA, 560 bp, Homo sapiens
  misc_feature: GZ8MTXP02F87O9.51.76.G10.1.454.CMB.2.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtncagctggtggagtcgtgggggagcgtggtccaggcccgggagtccctgagactctcctgtgcagcctntggattcaccttcagtgcctagtcggcatcgcacgtcgggccgccaggcctaccgaagggccgaaagggggctaggggacggttggggtcgctaattttacagtcagtatggattggaactaggtaaataaaggagttacngacagttccgtacgtaggaacggcgtattcgaaccatcctaccgaagacgaactactaccaacgaacacctatgtactnacganaaagtaanaanatagtagagacgacgagacgacgacgtctcgtgttattgtgtacgacgaacgtacgtagtaggtagg

SEQ ID NO: 329259 - DNA, 518 bp, Homo sapiens
  misc_feature: GZ8MTXP02HVW4E.51.76.G10.1.454.CMB.2.raw
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcccggggagtccctgagactctcctgtgcagccctctggattcaccttcagtgcctatggcatgcacgtgggtcccgccagggcctccgaggcgaaggggctgggagtggggtggcatttanatcagatgatggcagtaatagngtatgcagtctcgtaggagggccgatcacatctacagagacaacttcccaagaaccacactgtatctagacaaatgaacagtatagagagctagaggacacggtntgtagttcttcgngtaacgacgaacgtcgtagtaggtaggtagggtagg

SEQ ID NO: 329260 - DNA, 588 bp, Homo sapiens
  misc_feature: GZ8MTXP02HD79M.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcaagaacctggaccaggcctcccgaggtcctcctcatctatgatgacatccaacgaacggcccaatgactactcccaagcctaggtcagtgctaggtgggctgggggacagtacgttcactcacaccatcagcacgctgctagtagtagaagttactttagacttaaattttattacttatacagtacaagtataaatacgtacggtacctaccgtactacgtttacgggacccgtaaacgggggtaaccctaaaggaccgttaacgggtaaacgtaacgtaaaccgtaaaacgtacgttacggtacggtaccgtacgtaaccgtacctaacg

SEQ ID NO: 329261 - DNA, 594 bp, Homo sapiens
  misc_feature: GZ8MTXP02GRKR9.51.76.G10.1.454.CMB.2.raw
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctctgtgcagcctctggattcaccttcagtgcctatggcatgcactgggtccnccaggctccgaggcgaaggggctgggaggtgggtggctatttanatcagtatgatggacaagtaaataacggngtatcgactagttccgtacggtagggaaacgggccctaacgttaccacctacttccctacccgaagaacggaaacctaaacgttaccccaaagtaaacccacgtaaccttagtactactagaacaaatcgaaatagattgagtagtcgagacggacacggtcttaggtagttacgttcgtaggtaacgaacgtaaacgtcttagacggtaggttacggggttaagggg

SEQ ID NO: 329262 - DNA, 613 bp, Homo sapiens
  misc_feature: GZ8MTXP02HHXGM.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgcgtaatgctctgggtctctggatccagtgggatattgtgatgactcagtctccactctccctgcccgtcaccctggagacgccgcctcactctcctgcaggtctagtcagacgcctctgctatagtatgatacaactagttgatgcacgtgacagaagccagggcagtcctaccagacggtcctgactcttatttagacgtttccgtaagtccccccggggaccccccgggtcctagaccgtaggttccaaggtcggctaaggtcggactcgacggactacgtaagttatttaacgactaagaaaatcaagtacgagtaggtaggaggacgtaggtaaggttagttagggtttacgggttaatcgtagttagactagtcgtaacgaagtccgtaactaactaaaaccgttcccgtaacgttacggtaaccgtttccgggacgggtaacgggtaaccgtacgggtaagtacgacgtaccgaaaggccgtaacgttggtaccgg

SEQ ID NO: 329263 - DNA, 551 bp, Homo sapiens
  misc_feature: GZ8MTXP02FKDAJ.51.76.G10.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaacctggccaggcctccaggctcctnatctatgatgcatccacgaacgggcccactgactactcccagccaggttcagtggctaggtggtcgtggggacagtacgttccactctacaccatcagcagcctgcagtctagaagttatttgacttaaatttattactgtacagtactaagttaataactaacgtcggtaccctacgttactacgtttcggaccgtaacggggaccaaggtcgtagggaactacgtaacgaaaacgtaacgtggtacggacgtacgacctacctacg

SEQ ID NO: 329264 - DNA, 541 bp, Homo sapiens
  misc_feature: GZ8MTXP02FY4XM.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccaggctcctcatctatgatgcatccacgaaggcccactgactactccagcctaggttcagtggctaggtgggtctggggacaggtagttcactctcacatcagcagcctgcagtctagtaagttactttgacttaatttattactgtcagactaagtaataataacgtcggtccttaccgtactacgtttacggaccgtacggggacctaaggcgtaggaacgacgtaaccgaaaacgtacgtaggtacggactacggacctactacg

SEQ ID NO: 329265 - DNA, 638 bp, Homo sapiens
  misc_feature: GZ8MTXP02HBA81.51.76.G10.1.454.CMB.2.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtcgcctatggcatgcacgtcggggtcccnccagggcctccgagggcgaaggggctgggaggtgggtgctatttanatcagatgacgtggactaagttaaataaggngttatcgactagtccgtaccggtaggaaacggggcctaattccaacctattccctaccgaagacgaaactaaacttaccccaaagaaaccaactaacgttagttaactcgtagaacctaaaagtcgaaaactagtaattaggaaagacgacgtaggaacggaaccgtaccggtcttaggttacgttaactttcgtagggttaacgaaaccggtaaaaccggtcgttaaggttaggggtaagggtttagggggtaaaaggggg

SEQ ID NO: 329266 - DNA, 588 bp, Homo sapiens
  misc_feature: GZ8MTXP02HJ5M6.51.76.G10.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
  modified_base (487)..(487): a, c, t, g, unknown or other
  misc_feature (487)..(487): n is a, c, g, or t
  modified_base (560)..(560): a, c, t, g, unknown or other
  misc_feature (560)..(560): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggattcaccttcagtgcctatggcatgcacgtgggtcccnccaggcctccgaggcaagggggctgggagtggggtggctaattttnatcagatgatggacaagtaaanaaggagttatgctagtcctaccgggtaggaaacggggtcctacgttccacctatccctaccgagaacgaacctaacttaccccaagaaaccacctactgttaactcctagacaaaatcggaaanagtagtagagagcgtaggacggacgacggtcgttagttacgttacgtttcgtagtaacggaacgtaaacggtntaaggtagggtagggttaggggtaaggg

SEQ ID NO: 329267 - DNA, 526 bp, Homo sapiens
  misc_feature: GZ8MTXP02HMG2G.51.76.G10.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtagcagcgacttagcctggtaccagcagaaacctggccaggctcccaggctcctnatctatgatgcatccaacgaagggcccatgatactccccagccaggttcagtgcaggtgggtctggggacagagttccactctcaccatcagcagcctgcagtctagaagtatttgacttaaatttattacttgtacagactaaatataataacgtcgtacctacgtactacgtttcggaccgtagggtaccaagtcgtaggacgactaacgaaacgtaacgtgtacggctacgactaccta

SEQ ID NO: 329268 - DNA, 546 bp, Homo sapiens
  misc_feature: GZ8MTXP02FRFTI.51.76.G10.1.454.CMB.2.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcacgtgggtccnccaggcctccgaggccaagggggctgggaggtgggtggctagtttanatcagatgatggacaagtaaatagngtangcagtctccgagaacgggccgtattcaaccagtcctccaagtacgaactaacttacccaagaaaccacactgtatctagacaaagtgaaacagtaatgaagtagacgtaggacggacacggtattggttacgttattcgtgtaagacgaaacgtctagtaggaggtgggtaaggg

SEQ ID NO: 329269 - DNA, 701 bp, Homo sapiens
  misc_feature: GZ8MTXP02I8QL0.51.76.G10.1.454.CMB.2.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggaggtcccctgagacctctcctgtcgcagcctcgtggacttcaccttcagtcgcctanggcatcgcacgtcgggtccncgaggcctaccgaggccgaaggggtctagggaggtggggtgactagttttanacgtcgagtagtagagtaggactagaaattaaaggagttagtcgtacgtacgtccgtacggtaacgggtaacggtaccgttaacgttacctaccgacaacgtacgtacccgtaacgtaaccgtaaaccgaaacttaaccctaaccgtaacgtaacgaacttacgtacgtaaacttaacgtaacgaaacgtaagtaacgtaaacggaacgtacgtaacggtaaacgggtaaccgtaaccggtaacgggtaaccggttaccggtaaccggtttacgtttaacggttaacggtttaccggtaaaccggttaaccggtaccggtaaaaccggtaacggttaacggg

SEQ ID NO: 329270 - DNA, 544 bp, Homo sapiens
  misc_feature: GZ8MTXP02JL5OK.51.76.G10.1.454.CMB.2.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctctggattcaccttcagtgcctagtggcatgcacgtcggggtccnccagggcctccgaggcgaaggggctagggagtggggtgctatttanatcagatgatggacaagtaatagngtatgactagtcgtacgtggaacgggccgtattcaccatcctcagacgaacaacttaccagtaaacactatgtatctagacaaatgaacagtataggagagcgtaggaggacacggtntgttagttacttcgtagtaagacgtaaaacgctaggtaggtacggtaggggtaaaggg

SEQ ID NO: 329271 - DNA, 686 bp, Homo sapiens
  misc_feature: GZ8MTXP02JGB9R.51.76.G10.1.454.CMB.2.raw
  modified_base (339)..(339): a, c, t, g, unknown or other
  misc_feature (339)..(339): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattcaccttcagtgcctatggcatgcacgtggtccgccaggctccgaggcgaaggggctgggagtggggtgctatttanactcagtatggatggacagtaaataaaacggagttagtgacgtaaggttccttacccgggtaggaaaccgggtccgtaactttacccgaacccgtactaccctaacccgaagtaaacgaaccctaaaactttaccccgaaaagaaaccctaaacccttacgttacgttaactaccgttaacgaaaccctaaaaagttaccgaaaacgtaggttaaagtttacggaaacggtaggacggttacgggaaaccgggtaaaccgaaccgggggtttacgttacggtttagtttacgtttcggtacggtaacgtaaaccggtaaacgtacgtttaacggtagggtaaagggg

SEQ ID NO: 329272 - DNA, 658 bp, Homo sapiens
  misc_feature: GZ8MTXP02IK4X8.51.76.G10.1.454.CMB.2.raw
  modified_base (580)..(580): a, c, t, g, unknown or other
  misc_feature (580)..(580): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctcgtggtacttccacccttcagtcgcctagtggcagtgcacgtgggtcccgccaggcctaccgagggaccggaaggggtcgtgggaggtggggtggtactaatttagtatcgaagtatcgattagggactaaaggttaaaaataaggagttaacagtaccgtaggttcccgtacggtaagggaaaccgggggtacctagttacccaccgtaacttccctaccgaagaacgtaaaccaaacgttaccccaaagaaaccactacctttagtaatcctagaacaaaagtagaaatagtaagtagaagagacgtaggaacgacgaacggtnttacggttagttaactttgtacggtaacggaaacgtaaacgtacgttaggtaggtaaggggtttaggggtaaaggggg

SEQ ID NO: 329273 - DNA, 506 bp, Homo sapiens
  misc_feature: GZ8MTXP02JUXVT.51.76.G10.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (452)..(452): a, c, t, g, unknown or other
  misc_feature (452)..(452): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggagtccctgagactctcctgtgcagcctctggattcaccttcagtgcctatggcatgcacgtgggtccnccaggctccgaggcaaggggctgggagtggggtgctatttanactcagatgatggcagtaaataaagngtatgcagtctcgtgaaggccgatcacatctcagacgacaacttcccgagaaacacactgtatctagacaaatgaacagattagagagngtgacggacgacgcgtgtagtagttcgtgtacgacgaacgacgtagtagtaggg

SEQ ID NO: 329274 - DNA, 631 bp, Homo sapiens
  misc_feature: GZ8MTXP02HMGY4.51.76.G10.1.454.CMB.2.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcccgggaggtccctgagctctcctgtgcagcctcgtggattcaccttcagtcgcctagtcggcagtcgccgtaccgtcggggtccccnccgagggcctcccgagggcgaggggctgggaggtgggtgctatttantcagtatgatggactaaaggttaaataagtgtangacgtagttcctaccgggtagaacgggccgtattaccaaccgtatccgtaccgaagaacgtaacctaaccttaccccgaaagaaaccaactacttagttaactacctagaaactaaagttacgaaacgaagtagttaaggagacgtacgtaggacggaccgaccggtgttacgttgttaacgtttcgtagtaacggtacgtaaaaccgtcgtaaggtggaaggggtttaggggtaaagggg

SEQ ID NO: 329275 - DNA, 555 bp, Homo sapiens
  misc_feature: GZ8MTXP02JHAMM.51.76.G10.1.454.CMB.2.raw
  modified_base (188)..(188): a, c, t, g, unknown or other
  misc_feature (188)..(188): n is a, c, g, or t
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagcccgggagtccctgagactctcctgtgcagcctctggattcaccttcagtgcctatggcatgcacgtgggtcccgccgaggcctccgagggcgaagggggcctggggagtggggtcggctagtttanatcgagatggatggactaggtaaataaagagtangctagtctccgtagaacggcattcactatccncagtacgacaactacccaagaaccacactgtactacngacaaatacgaaacagtatagaagtacgacgtaggaacggacgtaacgggttctacgttagttacgttcgtaggtacgtacggaacgtcgtaagtaggtaacgg

SEQ ID NO: 329276 - DNA, 728 bp, Homo sapiens
  misc_feature: GZ8MTXP02HKHXZ.51.76.G10.1.454.CMB.2.raw
  modified_base (297)..(297): a, c, t, g, unknown or other
  misc_feature (297)..(297): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattccaccttcagtcgcctatggcatgccacgtcgggtccnccaggcctaccgaggccgaagggggctggggaggtggggtggactaagtttatacgtcgagtagtgagtgggactaaaggttaaataaggtagttatacggactaggttccgtaccgggtagggaaacgggggtccctaacgtttaccgaaccctaacgtttcccgtaacccgaaagggaacgtaaacccgttaaaaccgtttaccccccgaaaaggtaaaaccctaccctaaccgtttaaggttaacttacccgttacggaaacctaaaacttacggaaaacggtaacgttaaacgtttaggaaacgtaggtaccggtaagggaaccggggaacctacggggtcgtttaggttacgttaacgttttccggtaggtaacggtaaccggtaaacgtcgttaaggtggtacggggttaggggttaaacggggg

SEQ ID NO: 329277 - DNA, 516 bp, Homo sapiens
  misc_feature: GZ8MTXP02I2BEM.51.76.G10.1.454.CMB.2.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattcaccttcagtgcctatggcatgcacgtgggtccgccaggcctccgaggcgaaggggctggagtgggtgcatttanatcagatgatggcagtanaaagngtangcagtctcgngaaggcgatcacatcncagagacatcccanacacatgtatactgacaatgaaacagtagtgaacgagtcgtaggacggtaacgacggcgttagtgttaacttttcgngttacgaaccgtaaaacgtcttaagtaggtaagggg

SEQ ID NO: 329278 - DNA, 562 bp, Homo sapiens
  misc_feature: GZ8MTXP02JQ4EB.51.76.G10.1.454.CMB.2.raw
  modified_base (386)..(386): a, c, t, g, unknown or other
  misc_feature (386)..(386): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctctgcatagtattggatacaactattggattggcacctgcagagccgagggcagtctccacgaggtcctagactcttatttgacgttctaacgtcccccggggtcccccgggtcctgacctggttcagtcggcagtcggatcgaggcactagtatttanactagaaactcgagcaggagtgggagcgtaggagttagttgggtttagggttaatcgtaagtttcgactagttcgactaacgtctactaaactaaccttccgtacgtacgttaccgttcgggacgggtaacggaccgtaaggggtgaacgtacgtacgaagaccgtaagtcgacgg

SEQ ID NO: 329279 - DNA, 568 bp, Homo sapiens
  misc_feature: GZ8MTXP02JAD8O.51.76.G10.1.454.CMB.2.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggaggcgtggtccagcccgggagtccctgagactctcctgtgcagcctctggattcaccttcagtgcctatcggcagtcgcacgtggggtcccgcagggcctcccgaggccgaaggggctgggagtggggtggctagtttanatcagatgatggcaagtaataaggngtatgctagtactcggtaggaaaggggcctagttccaccattccctacagagtaactaacgttaccccaagaaaccactacttgttataccgtagaaccaaagtgaaacagtaattggaacgngactaggacgacgacggtctagttcgttatttcgtagtggacgaaacgtcgtaagtggaggttacggggtaaggg

SEQ ID NO: 329280 - DNA, 570 bp, Homo sapiens
  misc_feature: GZ8MTXP02IQ2NJ.51.76.G10.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcccgggaggtccctgagactctcctgtgcagcctctggattcaccttcagtgcctatggcatgcacgtcgggtcccnccaggcctccgaggcgaaggggctgggaggtgggtgctatttanatcagatgatggacaagtaaatagntatgacagtctcgtagaggcgatcacatctcagacacaactaccagaaacacactgtatctagaactaaatcgaacagtaagttgaaagagacgtaggaacggtaccaacggggtcttaggtttacgtttaacttttcgtaggttaacgaaccggtaaaaccggtcttaaaggtgggttaacggggtagggggttaaaggggg

SEQ ID NO: 329281 - DNA, 492 bp, Homo sapiens
  misc_feature: GZ8MTXP02FNRBA.51.76.G10.1.454.CMB.2.raw
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtcccgccaggctccgaggcaaggggctggagtgggtggcatttanatcagatgatggcagtaataagngtatgcagtctcgtgaaggcgatcaccatctcagagacattacccagaaacacactgtatctgacaaatgaacagattgagagctgaggacacggctgtgtatttcgtgtgacgaaacgctagtggagtgggtaagg

SEQ ID NO: 329282 - DNA, 531 bp, Homo sapiens
  misc_feature: GZ8MTXP02FWG3H.51.76.G10.1.454.CMB.2.raw
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgccctctgcatagtattggatacaactatttggattggcacctgcagaagccagggcagtctccacaggtcctgatcttatttgagttactaacgtccccggggcccccgggtccngacgtaggttcagtggcaggtgactcgagcacagtatttanactagaaatnancagagtgagngtgagattggttagggttatcgatcgntatgacaagctactaactaaactctacgttacgtacgtttcgggacggaacggtaccgaaagggtcggaagaacgtacgaacgtacgaacgttggtacgg

SEQ ID NO: 329283 - DNA, 603 bp, Homo sapiens
  misc_feature: GZ8MTXP02JJGU5.51.76.G10.1.454.CMB.2.raw
  modified_base (354)..(354): a, c, t, g, unknown or other
  misc_feature (354)..(354): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccggggaggtccctgacgactctcctgtgcagcctctggattcaccttcagtcgcctatcggcagtcgcctacgtcgggtcccgccgaggcctccgaggcgaaggggtctgggagtgggtgactatttanactcgagtatgatggactagtaaataaagacgtatcgactagtcctcgtagacgggtcctagttcaacctatcctaccgaagactaacctaacttacccaaagtaaccactactagtactacgtacgaactaaatacggaaactagtagttacgaagtacgtcgtaaggaacggtacgtaccgggttctacgttagtttatttcgaggttacgaaaccgtaaacgtacgtttacggaggttaaaggggg

SEQ ID NO: 329284 - DNA, 615 bp, Homo sapiens
  misc_feature: GZ8MTXP02H8EVP.51.76.G10.1.454.CMB.2.raw
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcccgggagtccctgagactctctgtgcagcctnggacttcaccttcagtcgcctagnggcatgccagtcgggtcccgccaggcctaccgaggcgaaggggctgggagtggggtcgtactatttanacgtcgaagtntgagtggactaagttaaagtaaaagacgttagtcgaccgtagttcccgtaccggtaggaaacgggtccctaagttacccacctattccgaccgaaggaactacctaaacttaccccaaagtaaccacttaactagtactactaagaacctaaagtacgaaacgtaagtagtaaggagtacgacgtaggaaacgacgtacggtacttagttagttattcgtaggtacgaacgtaaacgtcgtagttaggaagggg

SEQ ID NO: 329285 - DNA, 525 bp, Homo sapiens
  misc_feature: GZ8MTXP02GRIB7.51.76.G10.1.454.CMB.2.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagctctcctgtgcagcctcgtggattcaccttcagtgcctatggcatgcacgtgggtcccncaggctccgaggcgaggggctggagtgggtgctatttanatcgagatgatggactagtaaataaagngtanganagtctcgtgaggcatcacatcncagacacactacccagacacactagtactcagactaaatcgaaactagagttagaaagngtacgtaggaacggacacggtcgttagtacgttattcgtaggtacgacggtaacgtcgtagtacggtaagggg

SEQ ID NO: 329286 - DNA, 621 bp, Homo sapiens
  misc_feature: GZ8MTXP02GRQIN.51.76.G10.1.454.CMB.2.raw
  modified_base (303)..(303): a, c, t, g, unknown or other
  misc_feature (303)..(303): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtcgcctagtggcatcgccacgtcggggtcccnccagggcctccgaggccgaaggggctagggaggtggggtggactatttatatcagatgatggacaagtaaataagagtatgacagtctaccggtagaaacgggccgtaattccaacctatcctacaagaacgaacaactacccaagaaaccacactagtatactacgaactaaaagtacgaaactaagtaattaggaagacgtcgtaaggaacgggaaccgaccgggtacttacggttaggtttaactttcggttaggtaacggtaacggtaaaaccgtcgttaaggtagggtaaaggggttaggggtttaaaggggg

SEQ ID NO: 329287 - DNA, 572 bp, Homo sapiens
  misc_feature: GZ8MTXP02I6J76.51.76.G10.1.454.CMB.2.raw
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaaccnggccagctcccagctctcatctatgatgcatcacaaggccatgatatcccagccaggttcagtgcagtggtctgggagagagttcactctcacccaactacagacacgctgcacgtctagtaagtatttagtactaaatttaaatttaacttagtacgtagtacgtaagtaaattaaaattaaacgtacgtaccgtaccgtaaccgttaacgtttacggtaccggaacggggtaaaccggaaacgacgtacggtacgtaacgtaacgtaaaaccgtaaaacgtacgtacggacgtacgacgaactaacg

SEQ ID NO: 329288 - DNA, 554 bp, Homo sapiens
  misc_feature: GZ8MTXP02F5VB7.51.76.G10.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtgcngcctcgtggacttccaccttcagtcgcctatggcatgcacgtcgggccccncaggcctccgaggcgaaggggctgggaggtgggtgactattanatcagtatgagtggactaaagtaataagntactgactagtctacggagaacggcctatccactatcctacagacaacaactaccaataaacactactagtatctagacaaatagaaanagtatagaagacgacgtaggacggacgacggtacgttgttacgttattcgtagaacgtaacgaacgtacgtagtacggaggtagggttaaaggg

SEQ ID NO: 329289 - DNA, 630 bp, Homo sapiens
  misc_feature: GZ8MTXP02FM8KK.51.76.G10.1.454.CMB.2.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattccaccttnagtgcctagtggcatgcacgtgggtcccncaggcctccgaggcgaaggggctgggagtgggtgctatttantcgagatgagtggactaagtaaataacggtntagtcgacgtacgttcgtacgggtaagggaaccggtcctaactaccaactactacccgacgaagaactaacctaaccgtacccgaaagaaaccacgtacgttagtactacgtaagaaactaaagtacgaaacgtagtaagtacggaacgtacgtacgtaacgggaacggtacgtacggttagttacggttacgtttacgttcggtacggtaacgtaaacgtaacgtgtaaggtaggggtaacggggttagggggtaagg

SEQ ID NO: 329290 - DNA, 520 bp, Homo sapiens
  misc_feature: GZ8MTXP02JWSFO.51.76.G10.1.454.CMB.2.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccaggcccgggaggtccctgagactctcctgtgcagcctctggattcaccttcagtgcctatggcatgcactgggtccnccaggctccgaggcaaggggctggagtgggtgcatttanatcagatgatggcagtaatagagtatgcagtctcgtgaagggccgattcacatcncagagacacttcccagaaccacactgtatctagacaaagtacgaaacagattagagagctggacggacacgggtactggtagttactttcgtaggtcgacgtaaacggtctagtggaggttaggggtaagggg

SEQ ID NO: 329291 - DNA, 573 bp, Homo sapiens
  misc_feature: GZ8MTXP02GDYZV.51.76.G10.1.454.CMB.2.raw
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtncagcctctggattccaccttnagtgcctatggcatgcacgtgggtcccnccaggcctaccgaggcgaaggggctgggagtggggtgctagtttanatcagatgatgganaagtaaatagntatgctagtctcgtaggaacgggccgtatcacctatccgtacagaacgactaactacccaagaaacacacgttatactctagaactaaatagaaactaggtattagaagagctaggaacggtacgacgggttnttaggttacgtttacgttcgttaggaacgtaaccgtaaacgtcgtaaggtacggtagggttaggggtaaacggg

SEQ ID NO: 329292 - DNA, 568 bp, Homo sapiens
  misc_feature: GZ8MTXP02HNMLC.51.76.G10.1.454.CMB.2.raw
  modified_base (254)..(254): a, c, t, g, unknown or other
  misc_feature (254)..(254): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (546)..(546): a, c, t, g, unknown or other
  misc_feature (546)..(546): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtgcctatggcatgcacgtgggtcccgccaggctccgaggcgaaggggctgggagtggggngctatttanatcagatgatggacaagtaaataggntatgactagtcctaccggtaggaacgggtcccgtaattccaaccctattcctacccgaagtaacgaacctaaacttaccccaaagaaaccactacttagttactcgtagaacaaatagaaacagtattagagagctaggagtacgacggtctagtgttactttcgagttaagacgaaacgtntagtggaggttagggtaagggg

SEQ ID NO: 329293 - DNA, 613 bp, Homo sapiens
  misc_feature: GZ8MTXP02HRIJR.51.76.G10.1.454.CMB.2.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgacgactctcctgtgcagcctctggattcaccttcagtgcctagtggcatgctacgtcgggtcccnccaggcctccgagggccgaaggggctgggaggtggggtgctagtttanatcagtatgatggactaagtaaataaggngttatgactagttccgtaccggtagggaacggggtacctagttacccaactacttccctacccgaagaacgaacctaacttacccaagaaaccactactagttactactagaacaaagtagaaacagtagttaggaagtagacgtaggaacggacgtacggtcgttagttagttacgtttcgtaggtaacgtaacggtaaacgtcgttaggagggtagggttaggggtaaagggg

SEQ ID NO: 329294 - DNA, 582 bp, Homo sapiens
  misc_feature: GZ8MTXP02GUQED.51.76.G10.1.454.CMB.2.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtcgcagcctcgtggacttcaccttcagtcgcctatggcatgcacgtcgggtcccncgaggcctccgaggaccgaaggggctgggaggtgggtgactagtttanactcgagtatgagtggacagtaaanaaagagtatgctagtcgtcgtagaacggcatcactatccacaagacaactaacgttacccaagaaaccactactagtactacgtacgaacaaagtacgaaaactagtagttagaaggtacgacgtaggaacggtaccgtacgggtcttaggtacgtttagtttcgtaggttacgaaaccggtaaagtcttaaggtaggtaaggggg

SEQ ID NO: 329295 - DNA, 512 bp, Homo sapiens
  misc_feature: GZ8MTXP02HUDK6.51.76.G10.1.454.CMB.2.raw
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagccctctggattcaccttcagtcgcctatggcatgcacgtgggtccgccaggcctccgaggcgaaggggctgggagtggggtgctatttanatcagntgatgganagtaaataaagntatgcagtcgcgtgaggcgatcactatcctacaganacaacttaccagaaacacatcgtatctagacaaatgaaacagatagagtacgctaggacgacgacggtctagtgttacttgtgtacgacgaaacgtctagtgtagggg

SEQ ID NO: 329296 - DNA, 584 bp, Homo sapiens
  misc_feature: GZ8MTXP02GOLCA.51.76.G10.1.454.CMB.2.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgccacgtgggtccgccaggcctccgaggccgaaggggctgggaggtgggtggcatttanatcagatgagtggacagtaaataaagngtatgcagtctacgtaggaaacgggccctattccacctatcctacaganaacaacttacccaaagaaaccacactgtaactcacgaaacaaagtagaaactagtagttaggaacgacgtcgtaggaaacggtaaccgtacgggtcgttacggtttagtttagtttaacggttaggtacggtaacggtaaacgtcgttaaggtaggggtaaggg

SEQ ID NO: 329297 - DNA, 597 bp, Homo sapiens
  misc_feature: GZ8MTXP02HHHL9.51.76.G10.1.454.CMB.2.raw
  modified_base (195)..(195): a, c, t, g, unknown or other
  misc_feature (195)..(195): n is a, c, g, or t
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttagcagcgacttagcctggtaccagcagaacctggccaggcctcccaggcctcctcatctatgatgcatccacgaaggcccatgatacncccagccaggttcagtggctaggtggtctggggacaggagttcacttcncaccatcagcacgcctgactagtcgtagtaagttatttagacttaaattttattacgttgtacctaaggtactaagttaattaaactaaccgttcggtaccccttaccgttaccttacggttttacgggacccggtaacgggggtaaccctaaagggtaccgttaggggaacgtaacgtaaccgtaaaaccggtaacgtacggttacgggacttacggacctaaccgtaacg

SEQ ID NO: 329298 - DNA, 537 bp, Homo sapiens
  misc_feature: GZ8MTXP02JX8KB.51.76.G10.1.454.CMB.2.raw
  modified_base (375)..(375): a, c, t, g, unknown or other
  misc_feature (375)..(375): n is a, c, g, or t
  modified_base (410)..(410): a, c, t, g, unknown or other
  misc_feature (410)..(410): n is a, c, g, or t
  modified_base (455)..(455): a, c, t, g, unknown or other
  misc_feature (455)..(455): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcacgtgggcccgccaggcctccgaggcgaaggggctgggagtggggtgctatttagactcgagatgatgggacagtaaataaagagtangcagtctccggtgaagggccgtatccaccagtccncgagacgacaactcccagaaacacatgtactcagacaaatgaaanagtagttagagagtacagggaacgacgacggtcgtgtagttatttccgaggttacgacggtaaacgtcttaggtagtagggg

SEQ ID NO: 329299 - DNA, 526 bp, Homo sapiens
  misc_feature: GZ8MTXP02JY0CS.51.76.G10.1.454.CMB.2.raw
  modified_base (376)..(376): a, c, t, g, unknown or other
  misc_feature (376)..(376): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcctgcatagtattggatacaactattggattggcacctgcagaagccagggcagtctccacaggtcctgatctatttgagttctaacgtccccggggcccccgggtcctgactggtcagtggcaggtggatcgaggcacagtatttanactagaaaatcagcagagtggagctaggagagttggttgggtttatcgtattgctangactaagtctactaactaaacctctactacgtacgtttcgggacggtacggaccgaagggtcggaagacgtacgaagacgtaacgtggtacgg

SEQ ID NO: 329300 - DNA, 612 bp, Homo sapiens
  misc_feature: GZ8MTXP02HQNEM.51.76.G10.1.454.CMB.2.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccccgggagtccctgagacctctcctgtgcagcctntggattcaccttnagtgcctatggcatgcacgtgggtcccnccaggcctccgaggcgaaggggctgggaggtggggngctatttanactcaagtntgatcggatagtaaataaagagtactgactaacgtcgtacccgtaggaacggggtcccgtaagttccaaccctattccctaccgaagaacgtaacctaaacgtttaccccaaacggaaaccaacctaccgttagtaactacctagaaacctaaagtagaaaccgaagtagttagaagtagtacgttaggaacgtacgaacggtcgtacgtttgttaagtttcgtaggtacgacgtaaaccgtctagtaggtaagggg

SEQ ID NO: 329301 - DNA, 540 bp, Homo sapiens
  misc_feature: GZ8MTXP02JAHEA.51.76.G10.1.454.CMB.2.raw
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctctgtgcagcctntggattcacttcagtgcctatggcatgcacgtgggtccncaggctccgaggcaggggctgggagtgggtgctatttanatcagatgatggcaagtaatagngtaatgactagtctccggtaggaaacgggccgtattccacctatcctaccagacgaactaacgttacccaagaaacacactagtatctagtacaaatcgaacagtattagagagcgtagacggacacgggtcttagtgttactttcgtagtaacgacgtaaacgctagtggtaggtagggttaaggg

SEQ ID NO: 329302 - DNA, 576 bp, Homo sapiens
  misc_feature: GZ8MTXP02HLG3O.51.76.G10.1.454.CMB.2.raw
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggcccgggagtccctgagctctcctgtgcagcctctggattccaccttcagtcgcctagtggcatgctacgtcgggtccgccaggcctaccgagggccgaagggggctggggaggtggggngtctatttanactcgagatgactggacagtaaataaagntacgngacagtcctcgtaggacggtctactaccactactccacagacactactaccaacgaacactagtatactactagaacaagtaacgaacgagtagtagaagtacgtacgtaggaacggaccgtacggtcgttagttacgttagttcgtaggtaacgtaaccgtaaacgtacgttaaggttacgggtagggg

SEQ ID NO: 329303 - DNA, 605 bp, Homo sapiens
  misc_feature: GZ8MTXP02G1KI7.51.76.G10.1.454.CMB.2.raw
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagngtggtccaggcccgggagtccctgagctctctgtgcagcctctggacttcaccttnagtncctatggcagtgccacgtcgggtccnccaggcctccgagggcgaaggggctgggacggtgggtcggctattttacatcgagtatggagttggaactaggttaaaanaaaggngttaaatcggactaaggttcccgtaccggtaggaaacggggtcctaacgttcaaacccgtataccctaccgaagtaacgactaacgttaccccaaaggtaacactactgtatccgtagacctaaatcgaaactagtaagtagaagtacgacgtaggaaacggtacaccgggtactgttacggttatccgtggtacgaccgaaagtctaaggtaggtacggg

SEQ ID NO: 329304 - DNA, 635 bp, Homo sapiens
  misc_feature: GZ8MTXP02HG0I5.51.76.G10.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcgagggccagtcagagtgttagcagcgacttagcctggtacccagcaagaacctggccaggctcccaggctccncatctatgatgacactcccgaacgaacgggcccaacgtgaactacctccccgagtacccgtagggtttacccaaggttcgggaccgtaaggggttcggggtccttagggggacctaaggtaccggtttacccaacgttccctacaaaccctatccgaacgaccacgccttcgacgtagtaccgtagtaagttagttttacgtaactttaaattttattacgttgtactagtacgtagtaataataacgtcgtacccttacgtacgtacgtttcggaccgtacgggtaaccgaagtacgtaggacgtaacttacgaaaacgtacgtcggtacggacgtacgacctactac

SEQ ID NO: 329305 - DNA, 597 bp, Homo sapiens
  misc_feature: GZ8MTXP02FUM30.51.76.G10.1.454.CMB.2.raw
  modified_base (154)..(154): a, c, t, g, unknown or other
  misc_feature (154)..(154): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccaggcccgggagtccctgagactctcctgtgcagcctcgtggacttcaccttcagtcgacctagtggcatgcacgtcgggtccnccgaggctccgaggcgaaggggctagggaggtgggtgctaagttttanacgtacgagtagtgagtaggaactaaggtaaataaaggtagttagngacgtacgtccgtacggaggaacggcctaactaccaactactccacgaagacaactaactacccgaaagaaaccacgtacgttagtactacgacgaactaaagtacgaaataagtagtagaagacgacgaggacggacgtacggtacgtacgttagttacgttaacgtacgtacggtacgtaacgtacgtacgtaggtagg

SEQ ID NO: 329306 - DNA, 505 bp, Homo sapiens
  misc_feature: GZ8MTXP02FIYRL.51.76.G10.1.454.CMB.2.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctctggattcaccttcagtgcctatggcatgcactgggtcccgccaggctccagggccaaggggctggagtgggnggctatttanatcagatgatggcaaggtaaataagngtatgacagtctccgtagaagggcgtatcacatctcaganacaatccanaacacactgtatctagacaaatagaacagatagagagctagaggacgacggctagtgttattcgtgtgacgaaacgctatggaggtagggtaagg

SEQ ID NO: 329307 - DNA, 648 bp, Homo sapiens
  misc_feature: GZ8MTXP02I7GB6.51.76.G10.1.454.CMB.2.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcccgggaggtccctgagactctcctgtgcagcctntgattccacccttnagtgcctatggcatcgcacgtcggggtcccnccagggcctccgaggcgaaggggctgggaggttgggngctaatttanagtgagagtgagtggaataaagtaaataggtntagtcgactacgtccgtacggagggaacggtcctaactcccaactactaccgtaccgaacgaaacgtaacctaacctacccaaacgtaaaccctaactacgttacgttaactacgtaacgaaactaaagtacgaaactagtagttaggaacgtacgtacgtacggaacggtacgtacggtagttacggttacgtttacgtttcgtaggtaacggaaaccgtaaacgtacgttaaggtacgggttaacgggggttaacggggtaaggg

SEQ ID NO: 329308 - DNA, 660 bp, Homo sapiens
  misc_feature: GZ8MTXP02IMTVI.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgccccgtcaccccgtggacgacggcccggccctccatcctcctgctaggtctagtcagacgccctcctgactatagtatggatacaacttattgatggcacctgcagaagccgagggcacgtcctaccgactacggtcctgtacttcttatttagacgtttaccgtaacggtccccccggggtcccccccgggtcctgaccgtagggtttccagggtcgggacaggtcgtatcgaggactaacgtaagttatttaagtaacgtaaagtaaaactcgtaacgacgtaaagggtaggtgggacggtgtagggtaagggttagttgggttttaggggttatcgtaagttgacgtagttcgactaacgtcctaactaaaccttaaacgtccttaacggtacttaaccggttcgggacggggtaacgggtaaccgtaaggggttaacgggaaactacggtaaccgaagggtaccgtaacggtaggttacgg

SEQ ID NO: 329309 - DNA, 628 bp, Homo sapiens
  misc_feature: GZ8MTXP02IKSSH.51.76.G10.1.454.CMB.2.raw
  modified_base (385)..(385): a, c, t, g, unknown or other
  misc_feature (385)..(385): n is a, c, g, or t
  modified_base (529)..(529): a, c, t, g, unknown or other
  misc_feature (529)..(529): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggcccgggagtccctgagactctcctgtgcagcctctggattcaccttcagtcgcctagtggcatgccacgtcgggtcccgccagggccctaccgagggacgaaggggcgtgggagggttggggtggactaattttagatcgagtatgatgggactaaagttaaanaaggtatatgacgtacgttcgtccgggtagggaacgggtccgattaccgacctacttacccgtacccgaagaacgaacctaaacttaccccgaaagaaaccactaacgtagttactactaggaactaaagtacgaaactaagtnttaaggagacgacgtaggaacggacgaacggtcgttacgttagtttactttccgtagtaacgacgaaaacgtcgtagtagggtaggttaggggtaaggg

SEQ ID NO: 329310 - DNA, 641 bp, Homo sapiens
  misc_feature: GZ8MTXP02GCJHJ.51.76.G10.1.454.CMB.2.raw
  modified_base (418)..(418): a, c, t, g, unknown or other
  misc_feature (418)..(418): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgggagtcggtgggggaggcgtggtccaggcccgggaggtccctgagactctccgtgtgcagcctcgtggacttcaccttcgagtcgcctatggctagtcgcctacggtcggggtccccgccgaggggccctacccggaaggggccggaaagggggtcgtggggagggttggggtggtacttagtttatatcgaagtagtgaagtggataaagttaaaataaggngtaatgacctgttaccgtacggtaggaaacgggtcctataccactactcctaccagtaacgaacctaactacccaacgtaaacacctaagtacgtactactacgaacaaagtagaacgaagtagtagaagtagactaggacggacgacggtactcgttagtttaacgttcgttaggaacgtaaaccgtagtacgtagtagggtagggtagggtttaaaggggg

SEQ ID NO: 329311 - DNA, 565 bp, Homo sapiens
  misc_feature: GZ8MTXP02IZXV1.51.76.G10.1.454.CMB.2.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaanagccacctctcctgcagggccagtcagagtgttagcagcgacttagcctggtaccagcagaaacctggccaggcctcccaggcctcctcatctatgatgacatccaacgaaggcccatgactactcccagccaggttcagtgctaggtgggtctggggacaggtacgttcacgtctacaccatcagcacgcctgctagtctagtaacgtagtttcgacttaaattttattactgtactagtactaagttaataataacgtcggtaccttacgtacttacgtttacggaccgtaacggggaccaaaggtcgttaggaacgtaacgtaaccgaaaacggtacgtaggtacggactacggacctaaccgtacg

SEQ ID NO: 329312 - DNA, 787 bp, Homo sapiens
  misc_feature: GZ8MTXP02IVYJX.51.76.G10.1.454.CMB.2.raw
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggcccggggagtccctgacgtactcctccgtgtcgcacgtcctcgtggtacttccacctttcgaggtcgcctagtcggactagtcggacctaccggttccggggtccccgacccgacgggtccctacccggaaggggacccggaaaggggggtccgttaggggtagggttggggtcggtactttaaagtttttanagtacgaagtataggtagtgggaactaaaagggtttaaaaanaagggtacgttaagtacgtaccgttacggttacccgtacgggtaacgggaaaccgggtaccttaacttacccaaccttacgttacccgaacgaacggtaaaccgtaaacccttaaaccgttaccccgaaaacgtaaaccctaaccgttacgttacgtttactacgtaacgtaaaactaaaacgtaacgaaacgtaagtaaggttaggaagtacggtaacggtaacgggaacggtaaccggtcggttagtttggtttaacgtttacgtttcgtaggtaacggtaaccgtaaacgtacgttaggtaggttaaggggttagggggttaaggg

SEQ ID NO: 329313 - DNA, 648 bp, Homo sapiens
  misc_feature: GZ8MTXP02G3CLC.51.76.G10.1.454.CMB.2.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattcaccttcagtgcctatggcatgcacgtgggtcccnccagggcctccgaggcgaaggggctgggaggtggggtgctagtttanatcagatgagtggactaagtaaataaggtagttaanggactaggttccgtaccggtagggaaacggggcctaacgttacccaccgtaactcccgtaccaaggacaactaaacttaccccaagaaaccacctaacgttacgttaactacgttacgaacctaaaagtacgaaacgaagtaagttaggaagtagacgtaggaaacggtaccgaaccgggtcgttaacggttcgtttaacgtttcgtaggtaacggaccggtaaaacgttcgttaaggtacgggttaacgggtagggggtttaaaggggg

SEQ ID NO: 329314 - DNA, 506 bp, Homo sapiens
  misc_feature: GZ8MTXP02IAKSG.51.76.G10.1.454.CMB.2.raw
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcccgggagtccctgagactctcctgtgcagcctctggattcaccttcagtgcctatggcatgcacgtggggtccgccaggcctccgaggcgaaaggggctgggagtggggtggctatttanatcagatgatggcagtaaanaaagngtangcagtctcgtgaggcgatcacatctcagagacaatcccagaacacactagatctgacaaatgaaacagatagagaagctaggacgacacggtctagttgtatttcgngtagacgaaacgcgtaagtgtaaggg

SEQ ID NO: 329315 - DNA, 696 bp, Homo sapiens
  misc_feature: GZ8MTXP02HAHCR.51.76.G10.1.454.CMB.2.raw
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (515)..(515): a, c, t, g, unknown or other
  misc_feature (515)..(515): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggcccgggagtccctgagactctcctgtgcagcctgtggacttcaccttcagtcgcctatggacagtcgcctacgtcggggtccccgccgagggccctacccgagggcccggaaagggggctggggaggtggggttggaccttaagttttanacgtgaaggtattggaagtgggactaaaggttaaaataaggngttactggactaaggtccgtaccgggtagggaaacggggtcctaacgttcccaacctattacccacgaacggaactaaacctaaaccttaccccgaaaanaaaccactaacgtacgtactaccgaagaaactaaagtacgaaactagtaagttaggaagacggtacgtaacggaacggtaccgtaacgggttcttacggtttacgtttacgtttcggtacgtaacggtaaaccgtaaacggttacgttaggtacggggtacggggttagggggttaagggg

SEQ ID NO: 329316 - DNA, 682 bp, Homo sapiens
  misc_feature: GZ8MTXP02H33YU.51.76.G10.1.454.CMB.2.raw
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggaggtcgtggggggagcggtggtcccaggcccggggaggtccctgagtactctcctgtgcagcctgtggtacttccacccttnagtcgcctagtcggcatcgcacgtccggggccnccagggcctaccgaggacgaaggggctgggagtcgggngntaatttanatnagatganaggataaagtaaagtaagtgtacngactagtccgtacgtagaacggtacctataccactactacctacgaaagaactaaacctaaccttacccgaaaacgaaacctacgtaagttacgtaactacgtaacgaaactaaacgtaaacgaaacgtaaagtaagttaaggtaaggtaacggtaacggtaacggaaacgggtaaccggtaacggtacggttacggttacgtttacgtttacgttacggttaacggtaaacggtaaaacggtaacggtaaggttacgggttaacggggttaagggggttaagggg

SEQ ID NO: 329317 - DNA, 593 bp, Homo sapiens
  misc_feature: GZ8MTXP02JMGPI.51.76.G10.1.454.CMB.2.raw
  modified_base (250)..(250): a, c, t, g, unknown or other
  misc_feature (250)..(250): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtncagcctctggacttcaccttcagtgcctatggcatgccacgtggggtcccgccgaggcctccgagggccgaaggggggtctggggaggttggggtggctaatttttanaacgtcagatggattgggactaggtaaanaaaggtagtactgactagtccgtccgtaggaacgggccgtattcaccatacctaccgaagacgaactaacttacccaagtaaccacgacttagtactacctagaacaaataggaaacagtagtagacgtagcgtaggacggacgacggtcgtaggttgttacgtttaagtcggtagaccggtaacgtcgttaggtaggtaaggggg

SEQ ID NO: 329318 - DNA, 546 bp, Homo sapiens
  misc_feature: GZ8MTXP02JHQGI.51.76.G10.1.454.CMB.2.raw
  modified_base (188)..(188): a, c, t, g, unknown or other
  misc_feature (188)..(188): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggaggtccctgagactctcctgtgcagcctctggattccaccttcagtgcctagtggcatgccacgtcggggtccgccgaggcctcccgagggcgaagggggctggggagtggggtgctatttanactcagatgatggacaggtaaanaaagagtatgctagtctcgngacggcatcacatcncaganacactaccagaacactactagtactctagacaaatacgaaacagtagttaggaagacgacgtacggaacggacgaacggtcgttagtagtttattcgtagtacggacgtaaacgtcgttaggaggtaagggg

SEQ ID NO: 329319 - DNA, 573 bp, Homo sapiens
  misc_feature: GZ8MTXP02I3W4L.51.76.G10.1.454.CMB.2.raw
  modified_base (187)..(187): a, c, t, g, unknown or other
  misc_feature (187)..(187): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttggctgagctgggttttcctcgttgctcttttaagaggtgtccagtgtcaggtncagctggtggagtcgtgggggagcgtggtccaggcccgggagtccctgagactctcctgtgcagcctcgtggattcaccttcagtcgcctagtggcatgccacgtcgggtccgccaggcctccgaggcgaaggggctggaggtgggtgactatttanatcagatgatggactagtaaataaagagtatgctagtcgtaccgtagaacggggacacttacacccgtatcctaccagacgactacttacccaagaacactactagtactactagaacaaagtacaacgaagtagtagaagtagacgtaggacggaaacgacggtcgttacggttagttaacgtttccgtagtacggtaaccgtaaacgtcgtaacgtaggtaaggggg

SEQ ID NO: 329320 - DNA, 607 bp, Homo sapiens
  misc_feature: GZ8MTXP02FL9TQ.51.76.G10.1.454.CMB.2.raw
  modified_base (296)..(296): a, c, t, g, unknown or other
  misc_feature (296)..(296): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttcagtgcctatggcatgccacgtgggtcccncaggcctccgaggccggaaggggctgggagggtggggtggctagtttatatcagatgagtcggataagttaaataggagtaatgacgtagttccgtaccggtaggaaacgggtcccgtaacttaccaacccttatacccgtaccgaagtaacgaacctaacgttaccccaaagaaaccactactagtactactagaacctaaaanaacgaacgaagtagtagagacgacgtacggacggacgacgtacgttacgttacgttacgttacgtagtaacgtacgtaacgtacgtagtaggtaggtagggtaggg

SEQ ID NO: 329321 - DNA, 580 bp, Homo sapiens
  misc_feature: GZ8MTXP02JWEV8.51.76.G10.1.454.CMB.2.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagccctcgtggattcaccttcagtcgcctatggcagtcgacncgtcggggtcccnccgaggcctaccgaggccgaaggggctggggaggtggggtggctatttanactcagtatgagtggactaaggtaaataaaaggagttaagngacgtacgtccgtacggtaggaacggctacttaccacctactccacgaagactactaactacccaacgaaacactactagtactactacgaactaaatagaactagtagtagaagacgagaggacggacgacggtcgttagtattagttcgtagtacgacgtaacgtcgtaggtaggtacgg

SEQ ID NO: 329322 - DNA, 731 bp, Homo sapiens
  misc_feature: GZ8MTXP02FZJPX.51.76.G10.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (411)..(411): a, c, t, g, unknown or other
  misc_feature (411)..(411): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccaggcccgggagtccctgagctctctgtgcagcctctggattcaccttnagtcncctagtggcatcgcacgtcgggtcccnccgaggcctccgaggaccggaaggggtctggggacggttggggtggtactaaatttagtaacgtcaaggtagtgaagttacggggaactaaaaggttaaaaattaaacgggngttaactcggaccgttaacgttcccgttaccgggaaggggtaaaccgggggcccttaaacgtttacccgaaaccctacttacccgtaaccgaacggtaaacgtaaacccgtaaaccttacccccgaaagtaaaacccctaactaacccgtttagttaaccttacgtaacgaaacctaaaaacgttagaaaacgtaagtaagtttacggaagtacggacgtagggaacggaacgtacgggttacttcgggttacgtttacgtttcgttaggtaacggtaacgaaccgtacgttagtacggtagggttagggggttaaaggg

SEQ ID NO: 329323 - DNA, 601 bp, Homo sapiens
  misc_feature: GZ8MTXP02IGN67.51.76.G10.1.454.CMB.2.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccaggcccgggaggtccctgagactctcctgtgcagcctctggattcaccttnagtgcctatggcatgccacgtggggtcccnccaggcctccagggccaaggggctgggaggtgggtggctagtttanatcagatgagtggactaagttaaatagatatgctagtctaccgtaggaaggccgattcacctatctacgagacgacaacttacccaagaaccactactagtactctagacaaatacgaaactagtagttaggagtagtccgtaggaacggtaccgaaaccggtcgttacgggttacgtttaacgttttccgaggttaacggaaccggtaaaaacgtccgttaagttacgggaagggtttagggggttaaacggggg

SEQ ID NO: 329324 - DNA, 562 bp, Homo sapiens
  misc_feature: GZ8MTXP02JDM1A.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaacctggccaggctcccgaggcctcctcatctatgatgcatccacgaagggcccagtgatactcccagccagttcaggtgcaggttcgggtctggggacaggtagtccactctcaccatcagcacgcctgcacgtctagaagttatttgtacttaatttacttacttgtacagtactaagtataagtaacgtcggtccttaccgtacttacgtttacgggaccggtacggggtaccgtaacggtaccgttgggaacgtaacgtaacgaaacgtaacgttacggtacggccgtcgtacacctacg

SEQ ID NO: 329325 - DNA, 580 bp, Homo sapiens
  misc_feature: GZ8MTXP02HBW4I.51.76.G10.1.454.CMB.2.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagccctgtggacttcaccttcagtcgcctatggcatgcacgtcggggtccnccaggcctccgaggcgaaggggtctgggaggtggggtggctagtttanatcgagagtcgatgganaagtaaataagagtatgtagtctccggtgaaacgggccgtattaccaccatccctaccgagacgaaactaataccccaagaaccaactactagtactgtagacaaatgaaanaggtattagagagctaggacgaacncggtactggttacttagtttccgtaggtagaacgtaaaacgtcgtagtagggtaggtacgggggtaaggtttaaggggg

SEQ ID NO: 329326 - DNA, 509 bp, Homo sapiens
  misc_feature: GZ8MTXP02F0363.51.76.G10.1.454.CMB.2.raw
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtgcagcctctggattcaccttcagtgcctatggcatgcacgtgggtccncaggcctccgaggcaaggggctgggagtggggtgctatttanatcagatgatggcagtaataggtatgcagtctcggtgaacgggccgattcgacatccacagagacaactcccaagaacacactgtatctagacaaatgaaacagtatgaagngactaggagacncggtatgtcgttattcgtagtaagacgaaacgctagtggacgtgggtaaggg

SEQ ID NO: 329327 - DNA, 588 bp, Homo sapiens
  misc_feature: GZ8MTXP02IA3QP.51.76.G10.1.454.CMB.2.raw
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctctgtgcagcctctggattcaccttcagtgcctatggcatgcacgtcgggtccnccaggcctccgaggcgaaggggctgggaggtgggtgctatttanatcagatgatggactaagtaataagngttancgactacgtcgtacggtaggaacgggtccagttcacctatccctacgagaacgaactaaacttacccaagaaacactacgtacgttatctagactaaagtagaactagtaattgaagtacgtacgtagggacggtaaccggacggtacgttaggttcgttagtttcgtaggtaacgtaacggaaacgttcgtagtacggtaaggttaggggtttaagggg

SEQ ID NO: 329328 - DNA, 519 bp, Homo sapiens
  misc_feature: GZ8MTXP02FNC8A.51.76.G10.1.454.CMB.2.raw
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (467)..(467): a, c, t, g, unknown or other
  misc_feature (467)..(467): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgacgactctcctgtgcagcctctggattcaccttcagtgcctanggcatgcacgtgggtccnccaggctccgaggcgaaggggctgggagtggggtgctagttanagtcagatgatggacaagtaataagntangcagtcncgagaacggctatcacatctacagagacaactacccaagaacactactgtatctagacaaatgaacagtatagagagcgtagacgacacggtntacgtacgtacttcgagtcgaacgtaacgtgtagtaggtacggtagggtagg

SEQ ID NO: 329329 - DNA, 632 bp, Homo sapiens
  misc_feature: GZ8MTXP02HZ5UX.51.76.G10.1.454.CMB.2.raw
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
tcagcgatcgtatacacgaccggtgctcgatttagtcactcatacagggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctctggattccacttcagtgcctatggcatgccacgtcgggtcccnccgaggcctccgagggcgaaggggctgggaggtggggtgctatttanactcgagatgatggactagtaaaataaagagttatgacgaagttccgtaccgtaggaacggggtcccgtattacccaaccctacttccgtacccgaaagaaccgaacctaaaaccttaccccgaaacgaaaccaaccgtaaccgttagtaactcctagaacctaaaagtacggaaaacagtagtaacgaagtacgacgtaggaaacggaccgtacggtacgttagttacgtttacgtttcgtacggtaacggtaaccgtaaacgtacgttaaggttagggtagggg

SEQ ID NO: 329330 - DNA, 626 bp, Homo sapiens
  misc_feature: GZ8MTXP02GZU6K.51.76.G10.1.454.CMB.2.raw
  modified_base (168)..(168): a, c, t, g, unknown or other
  misc_feature (168)..(168): n is a, c, g, or t
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccaggcccgggaggtccctgagactctcctgtgcagcctntggattccaccttcagtgcctagtggcatgcacgtcgggtccncaggcctccgaggcgaggggctgggaggtggggtgctaatttanatcgagtatgagtggactaaagttaaataaggtacgtaatcggactaggtaccgtccgggtagggaaccgggctaacttccaaccgtactccgtaccgaagtaacgaaccctaaacttaccccgaaagtaaaccactacgttacgttaactccgttagaaccaaaagttagaaacgtagtagttagaagtacgtcgtaaggacggacgtacggtcttagttacgttagtttcgtaggtaacgacggtaaaacgtctaggtacggtaggggtagggtttaaaggg

SEQ ID NO: 329331 - DNA, 686 bp, Homo sapiens
  misc_feature: GZ8MTXP02H08NP.51.76.G10.1.454.CMB.2.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgagactctctgtgcagcctntggtacttcaccttcagtcgcctatggcatcgctacgtcgggtcccnccgaggcctccgagggccgaaggggctagggagtggggtgctattttanattcagatgagtaggactaaaggttaaaatagngttatcggcacgttcctaccgggtagggaaacgggccgtaacttaccaacctatacccttaccgaacggaactaacctaaaccttaccccgaaagtaaaaccctactaacctagtttactacctagtaaccaaaagttacgaaaacgtaggtaacgttaggaacggaagtacccgtagggaaaccgggaaaccgtaacgggttaccgttagggtttacgtttaacttttccgaaggtaaccggtaaacggtaaaaccgtcgttaaaggttcggggtaaaggggtttagggggttaaaggggg

SEQ ID NO: 329332 - DNA, 710 bp, Homo sapiens
  misc_feature: GZ8MTXP02I2WS2.51.76.G10.1.454.CMB.2.raw
  modified_base (588)..(588): a, c, t, g, unknown or other
  misc_feature (588)..(588): n is a, c, g, or t
  modified_base (599)..(599): a, c, t, g, unknown or other
  misc_feature (599)..(599): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagccgtggaggtcgtggggagggcggtggtccgacgccgggacggtccgtcgagactctcctgtgcacgcctctggtattctaccttctagtcgtcctatgcgatgcgacgtcgggtccgccgacgcgtccacggacggaacggggcgtggaggtggggtggtacgttaactttaaattagtacaagtaagtagtacgtaggacgtaaaggttaaaagttaaaaaggaggttagtaccggataccgttaccgttaccggtacggggtaaacggggacccgttactttacccaacccgtaacttcccgtaccgaaaacgggtacaaacctaaacccttacccaaacgaaaccctaactaaccgttagtacctttagaccgaataaaaacaagcgttaaaaggntttaaacgggngacgtacgtacggacggacgtaacgtcgttagtttagttcgttacgtggaacggtaaaccgtaacgtacgtaggttaggaagggggttacgggtttaaggggtttaacggg

SEQ ID NO: 329333 - DNA, 533 bp, Homo sapiens
  misc_feature: GZ8MTXP02GL69N.51.76.G10.1.454.CMB.2.raw
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgacgactctcctgtgcagcctctggattcaccttcagtgcctatggcatgcacgtggccgccaggcctccgaggccgaaggggctagggaggttgggtgctaatttanatcagatgatgganagtaaanaaagngtangcagtctcgagaggcatcacancncaganacatacccanaacacagtntactctagacaaatgaaacagtaagtagagtagacgtaggaacgtacgacggtcttaaggttgttacgtttgtacggtacgacggtaaaccgtattacgtaggtaaagggg

SEQ ID NO: 329334 - DNA, 506 bp, Homo sapiens
  misc_feature: GZ8MTXP02JDGZ6.51.76.G10.1.454.CMB.2.raw
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggaggtccctgagactctcctgtgcagcctctggattcaccttcagtgcctatggcatgcactgggtcccgcagggctccgaggcaaggggctgggagtggggtggctatttanatcagntgatggcaagtaatagngtatgcagtctcgtgaacggcgatcacatctcagacgacaactcccagaacacactgtatctgacaatagaacagattgagagcgtagaggacacggctggtgttacttcgtgtaagacgaaacgtctagtgtaggtagggtaacggg

SEQ ID NO: 329335 - DNA, 608 bp, Homo sapiens
  misc_feature: GZ8MTXP02I65IN.51.76.G10.1.454.CMB.2.raw
  modified_base (154)..(154): a, c, t, g, unknown or other
  misc_feature (154)..(154): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccaggcccgggagtcccctgagactctcctgtgcagcctntggacttcaccttnagtcgcctatggcatgccacgtggccncgaggctccgaggcgaaggggctgggagtggggtgctagttttacatcagatgatggacagtaaanaagtagtatcgcgtagttcgtaccgtaggaacgggcccgtaacttccgaacctatcccgtaccgtaaggaacaaacctacttaaccccgaaacgaaacctaccgtacttacgttactccgtaacgaacctaaagtacgaaaactagtaacttggaagagtcgtaaggaacggtacgacgggtcttacggttagttagttcgtaggttacgaaccggtaacgtacgtttaagagggtttaagggg

SEQ ID NO: 329336 - DNA, 593 bp, Homo sapiens
  misc_feature: GZ8MTXP02I6V4A.51.76.G10.1.454.CMB.2.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtgcagcctctggacttcaccttcagtcgcctagtggcatcgcacgtcggggtcccncagggcctccgaggcgaaggggctgggaggtgggtgctatttanatcgagtntgatggactaagtaatagngtaatgctagtcgtcggtagaacggctactaccactatacctacgacgaacgaactaacttacccaagtaaaccacctaacgtcgttactactagtaaactaaatacggaaactagtacgtagagtagcgtaaggacgacgtacggtcgttagttagttaactttcgtaggtaacgtaacgtaaacgtacgtaggtacgggtaaggtaggggtttaaagggg

SEQ ID NO: 329337 - DNA, 496 bp, Homo sapiens
  misc_feature: GZ8MTXP02HUO5N.51.76.G10.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgattagcctggtaccagcagaaacctggccaggctcccaggctcctnatctatgatgcatccacaagggccactgatatcccagccaggttcagtgcagtgggtctggggacagtgttcactctacaccatcagcagcctgctagtctgaagttatttgactatttattatgtcagcagtataatactgcctcgtactcgtttcgcgtaggggacagcgtacggatacacgaaaacgactaggtcgacgtcgactactac

SEQ ID NO: 329338 - DNA, 524 bp, Homo sapiens
  misc_feature: GZ8MTXP02GLXC2.51.76.G10.1.454.CMB.2.raw
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (450)..(450): a, c, t, g, unknown or other
  misc_feature (450)..(450): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtgcctatggcatgcactggggtccncaggctccgaggcaaggggctgggagtggggtgctatttanactcagatgatggacagtaaataaagagtatgacagtctccgtgaagggccattcactanctaccaganaacattacccaagaaacacactgtaatcagacaaatagaaanagagtagagagacgaggacgacgacgtcgtagttagttagttcgtcgtacgtacgaacgtacgtagtaggtagg

SEQ ID NO: 329339 - DNA, 695 bp, Homo sapiens
  misc_feature: GZ8MTXP02HO2NO.51.76.G10.1.454.CMB.2.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctccngcgagggccagtcagagtgttagcagcgacttagcctggtaccngcaagaaaccgtggccagggcctcccgaggtcctcctnactctatgactgcactaccgaacgaaggcccaacgtgaactacctccccgaggtcccgtaagggtttccaaggttcggacgtaggggttcgggggttccgtgggggaacctagggtaacgtttccaacttcccgaccaaccctactcgaacggcctaacggtcctggtactacggttacgtaagttaaagttatttttacgaacttttaaatttttacgttaactttgtacgtaagtcttaaagttaaattaaacgtaacgttaccggtacccgttaccgttaaacgttaccggttttacgggaaccggtaaacggggtaacccaaaggtccgtaaggggacgtaacgtaaaccgaaacggtaaacgttcgggtaccgtacgtacgtactacccgttaacg

SEQ ID NO: 329340 - DNA, 738 bp, Homo sapiens
  misc_feature: GZ8MTXP02JZMT2.51.76.G10.1.454.CMB.2.raw
  modified_base (256)..(256): a, c, t, g, unknown or other
  misc_feature (256)..(256): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctntggattccaccttcagtgcctatcggcatgcacgtcggggtcccgccgaggcctaccgagggccgaagggggctaggggaggtggggtggctaagttttanagtcgaagattgacgttggggactaaaggttaaataaagggtagttaacgtcgtaccgtaaggttcccgttacccgggtaggggaaacggggtcccgtaaatttcccaacccgtagttaccctacccgtaaaggaccgtaaacctaaacttacccccgaaagtaaaccctaaccgtaaccttaggttactacttacggaaacctaaaagtacgaaaacgtaaggttaagttaggaacgaggtaccggtaggaacccggggaacgacccggggttacttagggttacgtttaacggttttccggtaggttaaccggtaaaccgggtaaaacccgtacggtttaagggtacgggttaacggggtacgggggtttaaaaggggg

SEQ ID NO: 329341 - DNA, 598 bp, Homo sapiens
  misc_feature: GZ8MTXP02JDUOY.51.76.G10.1.454.CMB.2.raw
  modified_base (301)..(301): a, c, t, g, unknown or other
  misc_feature (301)..(301): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattccaccttcagtcgcctatggcatgccacgtcgggtcccnccgaggcctccgaggcgaaggggctgggaggtgggtgctaagtttacagtcagatgagtggactaaggtaaataaaaggtagttaatgacgtaagtcccgtaccggtagaacggggcctattaccactatcctaccgaagacgaactaacttacccaaagtaaccactacttagtactactacgaactaaagtacgaaanagtaattaggaagtagacgtaggaaacggaccacgggttcttaggttacgttacgttcgtacggtacgaacgtaacgtacgttaaggtagggtaagg

SEQ ID NO: 329342 - DNA, 603 bp, Homo sapiens
  misc_feature: GZ8MTXP02JPZ9B.51.76.G10.1.454.CMB.2.raw
  modified_base (259)..(259): a, c, t, g, unknown or other
  misc_feature (259)..(259): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcctgcaggttctagtcagacgccctcctgctatagtatggatacaacttnttggattggcacctgcagaagccgagggcagtcctaccgacgaggtcctagacttcttagtttcgagtttaccgaacggttcccccccgggggccccccggggtaccctaggaccgtacgggttcgagggttcggctaggtcggactcgaggacaacgtagttatttttaacaactaagaaatcgagacgaggtaggtagggaggctagggaggtagtttggggtttagggtttatcgtagttggtacagtcgactaacgtactacaaacctaactcctacgtacgtacgttacgggacggaccggtacgagggtaacgagtactacggagtacgaacgtggcg

SEQ ID NO: 329343 - DNA, 653 bp, Homo sapiens
  misc_feature: GZ8MTXP02GMWXN.51.76.G10.1.454.CMB.2.raw
  modified_base (351)..(351): a, c, t, g, unknown or other
  misc_feature (351)..(351): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattcaccttcagtcgcctatggcatgccacgtcgggtcccgccaggcctccgaggccgaaggggctgggaggtggggtgctagtttttanactacgagtagtgagtggaactagtaaaataaaggtagttagtcgacgtagttccgtacggtaggaaacgggccgtactaccacctactcctacgaagaacgtaacctaaaccttacccgaaacgtaaacctaacctaacgttacgttaactaccgtaacgaaactaaaagtaacgaaacgtaagtaacgttaggaacggtacgtacggtaaggaaacggtaccggtacggttcgttacgttacggtttacgtttcgtaggtaacgtaaccggtaaacgttacgttaaggtagggtaagggg

SEQ ID NO: 329344 - DNA, 553 bp, Homo sapiens
  misc_feature: GZ8MTXP02GK10A.51.76.G10.1.454.CMB.2.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtcgtgggggagcgtggtccaggcccgggagtccctgagactctcctgtgcagcctntggatcacttcagtncctanggcatgcactgggtccncaggctcgaggcaaggggctggagtgggtggctagtttanatcagatgatggacagtaatagntaatgaccagtctcgtgaacggcgaatcacntctacaganacatccagtaacacactagtatctagacaaatgaaacngtaattggaaagtgactaggaacggacgtaccgggtacttagtacgtttaacgtttcgttagttaacgggaaccgtaaaacgtccgtaagtttacgggaacggttagggggttaaagggg

SEQ ID NO: 329345 - DNA, 694 bp, Homo sapiens
  misc_feature: GZ8MTXP02IWIT1.51.76.G10.1.454.CMB.2.raw
  modified_base (254)..(254): a, c, t, g, unknown or other
  misc_feature (254)..(254): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggaggtccctgagactctcctgtgcngcctctggattcaccttcagtgcctagtggcatgcctacgtcgggtcccgccgaggcctccgagggcgaaggggctgggaggttggggtggctagttttatactacgagtataggagtgggactaagggttaaataaaaggaggttaatcggacgtaaggttccgtaccgggtaggaaacggggtcccgtaactttaccgaaccctaacttccctaccgaacggtaaacgaaacctaaacgttacccccaaacggaaacctaaccgtaacctttaggtacttacccgtaaggaacctaaaagttcgaaaaacgtaggttaagttagaaggtaggtccgtaaagggaacgggtacctaaccggggtctttacgggttgttttaactttccggtaggttacggtaaacccggtaaaagtccttaaggtcggttaaaaggggg

SEQ ID NO: 329346 - DNA, 634 bp, Homo sapiens
  misc_feature: GZ8MTXP02HTPNA.51.76.G10.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccccgggaggtccctgagactctcctgtgcagcctctggattcaccttcagtgcctatggcatgcactgggtccncaggcctccgaggcaaggggctggagtgggtgctagtttanatcagatgagtggactaagttaaagtaaggtagttaagtcgacgtagtccgtacggtagggaacgggaccgtacttaccaaccgtactccctaccgaagtaacgtaacctaaccttacccaacgaaacctactacttagtactactacgaacaaaagtaaacgaaacgtaagtaagttaggtaggtaagtacgtacggtaacggaacggtacggtacgttacggttacgtttacgtttacgttacggttaacggtaacggtaaacgtacgtaaggtaggtagggttaggggttaagggg

SEQ ID NO: 329347 - DNA, 718 bp, Homo sapiens
  misc_feature: GZ8MTXP02H7HQ9.51.76.G10.1.454.CMB.2.raw
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctctgtgcagcctgtggtacttccaccttcagtcgccttagtggcagtcgcctacgtcggggtcccaccgacgggcctaccggagggtaccggaagggggtcctaggggagggttggggttcggacttaaagtttttagaacttcgaaggtagtggtaagtcgggtaactaaaaggttaaaaagttaaacgggagtttaactcggtaccttaacgggttcccgtacgggtagggaaaccggggtacctaacttacccgaacctactcccgtacgaacggtaactaaccctaaaccttacccaaacgaaaccctaacgtaaccttagttaacttacgtacgtaaacctaaaacgtaagaaacgtagtaagttaggaagaacgtacgtaagggacggtaaccgtacggtacgttagttacgttacgtttcgtaggtaacgaccgtaaacgtcgtaagtggtaagggttagggtaagggg

SEQ ID NO: 329348 - DNA, 795 bp, Homo sapiens
  misc_feature: GZ8MTXP02IPJEZ.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagctctcctgtgcagcctctggattccaccttcagtcgacctagtcggacagtcgacctacggttcggggtccccgccgaggggtccctaccccggaaggggaccccggaaaagggggggtccttagggggaagggttcgggggtacgggtacctttaaaggtttttaataacgttccgaaaggtaagttacggtaagttaggggacctaaaggggtttaaaaattaaaacgggaagttagttaccgggccgtaaaggtttcccgtacccgggtaagggaaaccgggggtcctaacgtttacccaacccgtacttacccgtaacccgaaaggaaacgtaaccctaaaaccgtttaaccccgaaacgtaaaaccctaaccttaccgttaagttaacttaccgtaagaaaaccctaaaagttacggaaaactaaagtaagttaggaaacggaacggtacggttacgggaaacggaaaccgtacgggtacttcggtttagtttacgtttccgtaaggtacggtaaccgtaaaacggttcgtaagggttagggttaaggggg

SEQ ID NO: 329349 - DNA, 765 bp, Homo sapiens
  misc_feature: GZ8MTXP02F17IN.51.76.G10.1.454.CMB.2.raw
  modified_base (409)..(409): a, c, t, g, unknown or other
  misc_feature (409)..(409): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattccaccttcagtgcctatggctatcgctacgtgggtccccaccagggcctcccgagggccgaaagggggtcttaggggaggtggggtggtacttaaattttataatcgaagtagtggaacgtgggaactaaaggttaaaataaaggggngttaacgtacgaccgtacggttccgtaccgggtaaggggaaaccgggtacccgtaacgttacccaacctacgttacccgtaacccgaagtaaacgtaaaccttaaacccgtaacccgaaacgtaaaaccctaaccgtaacgttacgttaacgtaccgtaaacgaaactaaaacgtaacgaaaactaaggtaagttaaggaaggtaaccggtaacgtaacggggaaacgggtaaccggtaccgggtttacgtttagggtttaacgtttaacgttttccggtaaggtaaccgtaaaaccggttaaaacggtcggttaaaggttacggggtaacgggggtttaagggggttaaaggggg

SEQ ID NO: 329350 - DNA, 533 bp, Homo sapiens
  misc_feature: GZ8MTXP02I0ONI.51.76.G10.1.454.CMB.2.raw
  modified_base (294)..(294): a, c, t, g, unknown or other
  misc_feature (294)..(294): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctctgtgcagcctctggattcaccttcagtcgcctatggcatgcacgtgggccncaggctccgaggccaaggggctgggagtggggtgctatttanatcagatgatggacaagtaaatagntatcgatagtctcggtagaacggcgtatcacatcacaganacaactccaagaaccacactgtatctagacaaatagaanagatagagagacgacgaggacgacggtacgtacgttacgttacgttcgttagtaacgtacgaacgtacgtagtaggtaggtagggttaagggg

SEQ ID NO: 329351 - DNA, 563 bp, Homo sapiens
  misc_feature: GZ8MTXP02F18BN.51.76.G10.1.454.CMB.2.raw
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccaggcccgggaggtccctgagactctcctgtgcagcctctggacttcaccttcagtgcctatggcatgcacgtgggcccncaggcctccgaggccgaaggggctggggagtggggtggctaatttanatcagatgatggacaagttaaanagngtatcgctagtctccggtagaacgggcctatccacatcacagacgacaactacccaagaaacacatagtatctagacaaagtgaaacagtaattgaagtacgactaggaacggacgacggtcgtacgttagttaactttcgttagaacgtaccgtaaaacgtcgtaagtggtaacgggttagggtaaagggg

SEQ ID NO: 329352 - DNA, 714 bp, Homo sapiens
  misc_feature: GZ8MTXP02ID1IY.51.76.G10.1.454.CMB.2.raw
  modified_base (390)..(390): a, c, t, g, unknown or other
  misc_feature (390)..(390): n is a, c, g, or t
tcagcgatcgtatacacgaccggtgctcgatttagtcactcatacgagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggcccgggagtccctgacgactctcctgtcgcagcctgtggattcaccttcagtcgcctagtcggacagttcgcctacggtcggggtccccgaccgagggtcctacccggagggaccggaagggggtccgttaggggacgggttggggttaggacttaagtttttaanacgtacgaagtagtagagtaggtaacgtaaaggttaaagtaaggtagttacgtcggtacctacgttccgtacgggtacggacggtacctactaccactactacctacgaacgaactaactaacctaccgaacgaaacctacgtacgttagttactacgtacgaactaaagtaacgaaacgtagtacgtaggacgtacgtacggtaacggaacggtaccgtacggttcgttacggtttacgtttacgtttacgtaacggttaacggtaacgtaaacgttacgttaagggttacggggttaacggggtttaagggggtaaacgggg

SEQ ID NO: 329353 - DNA, 561 bp, Homo sapiens
  misc_feature: GZ8MTXP02GQP9N.51.76.G10.1.454.CMB.2.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (500)..(500): a, c, t, g, unknown or other
  misc_feature (500)..(500): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtgcngcctntgattcacttcagtgcctatggcatgcacgtgggtcccgcgaggcctcgaggcgaggggctgggaggtggggtggactatttanatcgagntgatggataagttaaataaggntangactagtcttacggaggaacggggcctagtaccacctatcccacgaaggacaactaacgtacccaagaaaccactacgtagtactctacgaacaaagtacgaagagtagttacgagagtcgaggacggacncggtactgttcgtatttccgtgaacgtaacgaagtactaggtaggtaggtaggggtaaggg

SEQ ID NO: 329354 - DNA, 602 bp, Homo sapiens
  misc_feature: GZ8MTXP02GE7GU.51.76.G10.1.454.CMB.2.raw
  modified_base (265)..(265): a, c, t, g, unknown or other
  misc_feature (265)..(265): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagctctcctgtgcagcctgtgattcaccttnagtgcctatggacatgcctacgtcggggtcccaccagggtccctaccgagggaccgaagggggtcctaggggtacggtggggtgactagtttagatcgagtatgagtggactaagttaaaataggatacgngctagtctcgggtagacgggctactcacatcctacagaacgtacactacccgaagaaccacacttagtactactagaacctaaagtacgaaacagtataggaagtacgacgtaggaccggagtaaccggtcgtaggttaccgttagtttccgtaggtaacgtacgtaaaacgtcgttagacggtaggggtacgggtttaaaggggg

SEQ ID NO: 329355 - DNA, 618 bp, Homo sapiens
  misc_feature: GZ8MTXP02JH5G8.51.76.G10.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaggggaaangcccacctncctgcagggccagtcagagtgttagcagcgattagcctggtacagcaagaacctggccaggcctcccaggctcctcatctatgatgacatccaacgaacggccactgactactaccccagcctaggttcaggttcggacgtagggtcgggtctagggggacaggtacgtttccacttcctacaaccctaatcgacgccacgtccctgactacgtctagtaaagtatttacgtacttaaatttacttacgtagtacgtaatataagttaactaagttaacgtacggtacccttaccggttaaaccttacgttttacggggacccgttaacgggggaaccctaaaggtaccgttacggaagttaacaacgtaaaacggtaacggtgttacggacctacgtaaccacccgttacg

SEQ ID NO: 329356 - DNA, 558 bp, Homo sapiens
  misc_feature: GZ8MTXP02G8PGJ.51.76.G10.1.454.CMB.2.raw
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (497)..(497): a, c, t, g, unknown or other
  misc_feature (497)..(497): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtggggtccnccagggcctccgaggccgaaggggcctggaggtggggtgctagtttanatcgaagtatgatggacaagttaataagtatggctagtctcggtaggacgggcgtattcaccatcctacagacgaactaacttacccaagaaaccacaacttcgtatccttaggaaccaaagtgaacagtattggagagctaggacgacgacggngtagttagttacgtttcgtgtaacgtacgaaacgtctaagtcggtaggttagggggtaagg

SEQ ID NO: 329357 - DNA, 625 bp, Homo sapiens
  misc_feature: GZ8MTXP02G3V5U.51.76.G10.1.454.CMB.2.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggacttcaccttcagtgcctagtggcatcgcacgtcggggtcccnccgaggcctccgagggccgaaagggggctggggaggttcggggtggctagttttanacgtcgagtatggagtggactaggtaaaataaagagttagtgacgtagtccgtaccgtaggaacgggtaccgtattaccgacctaacttccgtaccgaagtaacgaaccgtaacttaccccaagaaaccacgtactagtactactacgaactaaagtacgaaacgagtaagttaggaagtaacgacgttaggaacggaacgtaacggtcgttacgtaggtttaactttcgtggtacgacgtaaacggtacttaggtagggtaagggg

SEQ ID NO: 329358 - DNA, 620 bp, Homo sapiens
  misc_feature: GZ8MTXP02HPQLT.51.76.G10.1.454.CMB.2.raw
  modified_base (187)..(187): a, c, t, g, unknown or other
  misc_feature (187)..(187): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
  modified_base (523)..(523): a, c, t, g, unknown or other
  misc_feature (523)..(523): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccaggcccgggaggtccctgagactctcctgtgcagcctgtgattccaccttnagtgcctagtggcatgcacgtcgggtcccncagggcctaccgagggcaagggggctgggaggttggggngtctaattttanatcgaagatgatggactaagttaaataaggtgttancgactaagtccgtacgggtaggaaacgggccgtattaccaacctatcctaccgaagactaacgtaacttaccccaagaaacctaactacttagttactacgtagaaactaaaagtacgaaacgtaagtagtaagganaggtacgtaggaacggacgtacggtcttaggttacgttactttcgtacggtaacgaacgtaaacgtcgtaaggtcggtagggtaggggtttaagggg

SEQ ID NO: 329359 - DNA, 522 bp, Homo sapiens
  misc_feature: GZ8MTXP02G5OVR.51.76.G10.1.454.CMB.2.raw
  modified_base (384)..(384): a, c, t, g, unknown or other
  misc_feature (384)..(384): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactctccctgcccgtcacccctggagacgccgcctccatcctcctgcaggtctagtcagcgcctcctgcatagtattggatacaatattggattggcacctgcagagccgagggcagtcctcacgaggtcctgacttctagtttggagttcctaacgtcccccggggcccccggtcctgacgtacggttcaggtcgctagtgatcgagcactagtatttanactagaaatcagcagagtggagcgtaggagtagttggtttagggttatcgtagttgacagtgactagtcctataacctaactctatacgtacgttcgggacgacgacgtaaggngagtaacgacgaagcgaagtgacg

SEQ ID NO: 329360 - DNA, 639 bp, Homo sapiens
  misc_feature: GZ8MTXP02IWZOI.51.76.G10.1.454.CMB.2.raw
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagngccaccctctcctgcagggccagtcagagtgttagcagcgattagcctgtaccagcagaacctggccaggctcccaggctcctcatctatgatgactactaccgaacgaacgggccctactagacttaaccgacccccgaagtcccgtaacggttcacgggttggaccgtagggtcggggtcgtacgggggactagggtacgttaccaccttacgacctacccaaatccggacacccgaacgcccgttgacctacggtctaaggtaaaggttactttagaaccttaaattttattaaccgttnttacgtagtataagttaattaaacgtacgtcgtacccttaacgtacgttacggttaccggaccggtaacgggaacctaaaggtacgtaacggtaaactaacgtaaacgaaaacgtacgtcgtacggactcgactacctg

SEQ ID NO: 329361 - DNA, 580 bp, Homo sapiens
  misc_feature: GZ8MTXP02G1H9Y.51.76.G10.1.454.CMB.2.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtcgtgggggagcgtggtccaggcccgggaggtccctgagctctcctgtgcagctctggtntctctcngtgctntgcntgcncgtcggcgcgcgcgcgagcgaggngtggnggtggtgtgtattatctnagtagtagagtagagtagtaaagtaaagtagtagtagacgtacgtacgtacgtacggtacggtacgtacgtacgtacctacgtacctaccgaacgaacgaactaactaaccgtaacgaaacaactacgtacgtacgtactacgtaactaaacgtaagtaagtaagtagtagtagacgacgtaggacgacgtacggtacgtacgttagttagttaacgttacgtacggtacgtaacgtaacgtacggtaggtagg

SEQ ID NO: 329362 - DNA, 637 bp, Homo sapiens
  misc_feature: GZ8MTXP02GFEKR.51.76.G10.1.454.CMB.2.raw
  modified_base (198)..(198): a, c, t, g, unknown or other
  misc_feature (198)..(198): n is a, c, g, or t
  modified_base (331)..(331): a, c, t, g, unknown or other
  misc_feature (331)..(331): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccaccctctcctgcagggccagtcagagtgttagcagcgacttagcctggaccagcaagaaacctggccaggcctcccgaggcctcctcatctatgatgctatccaagaacgggccaacgtgactaaccncccgaagtccgtacggttcgaggtggacgtaggggttcggggtcgtaggggactagtacgttccacttctacaccatcgacgcgacgccgtgacgtagttcgtaagtaacgttagtttacgtaactttaatttacgttacgttagttacgtacgtaacgttaaagttaaacttaaacgttaccgtcggttacccgttaccgttaacgttaccggtttacgggaaccggtaacggggtaacctaaggtcgtacggaactacgtaaacgaaacggttacgtacggtacgtacgtacgacctacgtacg

SEQ ID NO: 329363 - DNA, 597 bp, Homo sapiens
  misc_feature: GZ8MTXP02I5WMN.51.76.G10.1.454.CMB.2.raw
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggcctccncatctatgatgcatccaacgaagggcccatgatactcccagccaggttcaggtggcaggtgggtcgtggggacaggtagttccactctccacctatcgacgcacggccctgactacgttctaggtaaagttacgttttgacttaaatttttacttacgttgtacagtactaagttaaacttaaattaacgtacggtcccttacgtacgttacgttttcgggacccgtaacgggggtaccaaaggtcgtagggaacgtacgtaaccgaaaacggtaccgttaggtacggtacgtacggaccgtaaccttacg

SEQ ID NO: 329364 - DNA, 586 bp, Homo sapiens
  misc_feature: GZ8MTXP02H97S2.51.76.G10.1.454.CMB.2.raw
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgccccgtcaccccgtggagacgccggcctccatcctcctgcaggtctagtcagacgcctcctgcattagtattggatacaacttattggattggcacctgcagagccagggcagtctccagaggtcctgattctatttgagtttactaacggtcccccggggccccccggggtcctaggaccgtaggtttccgaggttcgggctaggtcggatcgaggctacgtagttatttatacgtaagaaaatcgagtacaggtaggtgggagngtaggaggtagttgggtttagggtttacngtagttcgatagtggactaagcttactaaacctaacgtccttacgtaacgtaccggttacgggacgggtacggtaaccgaagggtcggaagtacgtacgtaacgcgtaacgtggtcg

SEQ ID NO: 329365 - DNA, 640 bp, Homo sapiens
  misc_feature: GZ8MTXP02IKJT5.51.76.G10.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccaggcccgggaggtccctgagactctcctgtgcagcctctggtacttcaccttcagtcgacctatggcatgcacgtcgggtccncaggcctccgaggcgaaggggctagggacgtggggtgctatttanatcagtatgagtggactaagttaaataaggtnttaancgactaggttcctacggtagggaacgggtccgattaccgaacctataccctacgaacgaacgtaaacctaactacccgaaagaaacctacctaacgttacgttactacgttagaaactaaagtacgaaactaaggtaagttaggaagtacgtacgtagggaacggaaccgtacggtacgttacgtttagttaaccttttgacgttaacggaacgtaaacgtcgtaagtacggtaacgggttaggggttaaaggg

SEQ ID NO: 329366 - DNA, 587 bp, Homo sapiens
  misc_feature: GZ8MTXP02I2I6W.51.76.G10.1.454.CMB.2.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggccccgggaggtccctgagactctcctgtgcagcctntggacttccaccttnagtgcctatcggcatgcacgtcggggtcccncaggcctcgaggccgaagggggctggggaggtggggtgctaagtttanatgagtatgagtggataagtaaataggtntacgtgactacgtcgtacggaggacggctactcactactccacagacgaactaactaccaacaacactactacgtactactacgaactaaagtacgaacgtagtagtagagacgtacgtacggacggacgtacggtcgttagttacgttacgttacggtagtaacgtaacgtaacgtacgtaggtaggtagggttagggtaaggg

SEQ ID NO: 329367 - DNA, 760 bp, Homo sapiens
  misc_feature: GZ8MTXP02GFWBP.51.76.G10.1.454.CMB.2.raw
  modified_base (342)..(342): a, c, t, g, unknown or other
  misc_feature (342)..(342): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtcgggtccgccagggcctccgaggcgaaggggctaggaggtggggtggctatttanatcagatgaagtggactaagtaaagtaagagtaagtgtacgtacgttacgtaccgggtagggaaaccgggtcccgttaacgttaccccgaaccgttaacttacccccgtaaccgaacggtaaaccgaaaacccgttaaacccttaaacccccgaaaacgtaaaacctaaacccgttaacctttacgttaaacttaccgtaaacggtaaaacctaaaacgttaaagaaaaccgttaaagtttaacggtaagggtaaagggtaacgaccggttaaaagggaaaccgggtaaccggtacccggttaacggtttcggttacgttttaaccgttttcggtagggtaaccggtaaaaccgggtaaaccgtttaacggtaggttaacgggggttaaccgggggttaagggggtttaaaagggggg

SEQ ID NO: 329368 - DNA, 566 bp, Homo sapiens
  misc_feature: GZ8MTXP02G5P2P.51.76.G10.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (503)..(503): a, c, t, g, unknown or other
  misc_feature (503)..(503): n is a, c, g, or t
  modified_base (522)..(522): a, c, t, g, unknown or other
  misc_feature (522)..(522): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggattcaccttcagtgcctatggcatgcacgtgggtccnccgagggcctccgaggcgaaggggctgggagtggggtgctatttanatcgagatgatggacaagtaaatagatangactaggtctcggaggacgggccgtattccactatcctacagacgaactaactacccaagaaccacactagttactctacgaacaaagttacgaaactagtaattaggagtagcgtaaggacggacgaccggtntacggttagttactttcgngtaagtacgaacgtctagtacgggtaaggtcgggttaaaggggg

SEQ ID NO: 329369 - DNA, 582 bp, Homo sapiens
  misc_feature: GZ8MTXP02FJVT1.51.76.G10.1.454.CMB.2.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtcccctgagactctcctgtgcagcctntggattcaccttnagtgcctatggcagtgccacgtcggggtccnccgaggcctaccgaggcgaaaggggctgggaggtggggtgactagtttanactcgagatgatggactagtaaataaagcgtangtacagtcctcggtaggaacgggccgtacttcaccactcctaccgaagacgaactaacttacccaagaacacactagtaactctagactaaatacgaaactagtatagaagagtcgtaggaacggacgacgggtacgttaggttagttacgtttcgtaggtacggtaacgaaaccgtacttaaggtaggtaaggggg

SEQ ID NO: 329370 - DNA, 672 bp, Homo sapiens
  misc_feature: GZ8MTXP02IYVB9.51.76.G10.1.454.CMB.2.raw
  modified_base (188)..(188): a, c, t, g, unknown or other
  misc_feature (188)..(188): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggaggcgtggtccaggcccgggaggtccctgagactctcctgtgcagcctctggattcaccttcagtgccctatggcagtgccacgtcggggtcccgccaggcctcccgaggcgaaggggctgggaggtggggtggtctagttttatactcgagtgtgatggactaggttaaataaaggagttagtgactaggttccgtacccggtggtaaacgggcccgtacttaccacccgtacttcctaccgaaggaacgtaacaaacctttacccccgaaaggtaaaccctaacccgtaactttacggtaactttacccgtaacggaacctaaaaagttacggaaaaccgtaggtagtttaagggaaacgaggtaccgttagggaaacggtaccgacgggttaccttcggttagtttacgtttaacggtgttacggtaaacgaaaccgtcgttaagtagggtttaaggggg

SEQ ID NO: 329371 - DNA, 537 bp, Homo sapiens
  misc_feature: GZ8MTXP02II3Y3.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggcctcccaggcctcctcatctatgatgcatccagaacggccatgatactcccagccaggttcagtggcaggtgggtctggggacagacgttcactctacacatcagcacgcctgcagtctagaattatttgacttaatttattactgtacagtactaagtataaatacgtcggtaccttaccgtactacgtttcggaccgtaacggggacctaaggcgtaggaacgtacgtaacgaaaacgtacgtcggtacggctcgacctactacg

SEQ ID NO: 329372 - DNA, 639 bp, Homo sapiens
  misc_feature: GZ8MTXP02J1RH8.51.76.G10.1.454.CMB.2.raw
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccccgggaggtccctgagactctcctgtgcagccctcgtggattccaccttcagtgcctatggcatgcacgtcggggtcccnccgaggcctcccgaggcgaagggggctaggggaggttggggtgactagttttanactcgaagtntcggatgggactaagtaaataaaaggagttangactagttcccgtccgtaggaacggcccgtattacccgaccctatcctaccgaagaacgtaaccctaacttaccccgaaagtaaaccactaaccgttatacgttacctagacctaaaagtcgaaaacgagtagtagaaggacgacgtagggaacggtaccgaacggtcgttacggttagtttaactttcgtacggtacggtaaacgtaaacccgtcgttaacggtagggtttaaggggg

SEQ ID NO: 329373 - DNA, 609 bp, Homo sapiens
  misc_feature: GZ8MTXP02HPXYW.51.76.G10.1.454.CMB.2.raw
  modified_base (381)..(381): a, c, t, g, unknown or other
  misc_feature (381)..(381): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcccgggagtccctgacgactctcctgtgcagcctctggacttcaccttcagtcgcctatggcatgcacgtcggtcccgccgtaggcctccgaggaccgaaggggctggggagtggggtgactatttatatcgagtagtgagtcgggataagtaaataggnttactgactagttccgacgtaggaacggtcgtaacttcacctattcctaccgagtaactacctaacttaccccgaagtaaacccacttacgtacgttactactaggaaccaaaagtaacgaagaagtaagttagtagtagacgtaggacggacgtaacggtcgttacgttcgttagtttacgtgtaacgtacgaacgtacgtagtaggtaggttagggtttaaggggg

SEQ ID NO: 329374 - DNA, 584 bp, Homo sapiens
  misc_feature: GZ8MTXP02HXH8F.51.76.G10.1.454.CMB.2.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacaggggggaaaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctggagactctctgtgcagcctctggacttcaccttcagtcgcctagtggcatgcctacgtcggggtcccgccaggcctcgaggcgaaggggtctgggagtgggtgctatttanatcagatgatggacaagttaaagaagngtangctagtctcgtaggaacgggcctatcacatccacgagacgactaactccaagaacacacgttgtaatctagaactaaacgagaaactaagtatacggaagtagtccgtaaggaacggtacgaacgggtcttaggttagtttaacgttcgtagttacggaacgtaaaccgacgttacgtaggtaggggtagggttaagggttaaaggggg

SEQ ID NO: 329375 - DNA, 635 bp, Homo sapiens
  misc_feature: GZ8MTXP02G9VL2.51.76.G10.1.454.CMB.2.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctgagactctcctgtgcagcctctggattcaccttnagtgcctagtggcatcgcacgtcgggtccncgaggcctccgaggcgaaggggtctagggagtggggtagactatttanatcgagatgagtcggactaagtaaataaggngtatcgactacgtccgtacgggtaggaaacggggtcctaattacccacctatccctacgaacgacgtaaacctaaaccttacccgaaacgtaaaccacctacgttacggtataccgttagaacctaaagtacgaaacgtagtacgttaggaagtacgtaccgtaggaaacggtactaacgggtcttaggttacgttacgttccgtagtaacggaaccgtaacggtactaggtaggtaggggttagggttaaaggggg

SEQ ID NO: 329376 - DNA, 655 bp, Homo sapiens
  misc_feature: GZ8MTXP02HNL4S.51.76.G10.1.454.CMB.2.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccctggagacgccgcctcatcctcctgcaggtctagtcagacgcctccngcatagtatgatacatnttgatgcactgcagagcgagggctacgtcctaccgacgtacggtcctagtacgttcttagtttgtacgtttaccgtaacggtcccccccggggtccccccgggtccttcggaacgttagggttccagggtcgggtacgtacggtggtaactcgaacggtacctaaataacgtttaatttaacgtaaacgtaaggtaaaactaccgagacgtaaggtaagggtgggaggtacgtagggtaggttaagtttgggttttaaggggttattacggtatttgacgtagtacgacgtacgtactaactaacctaaacctcccgtttaacgtaacgttaccgggttacggaccggggtaacggaaccgtaaggtaacggaagtacgtacggacggtaccgtaagttcggtaacgg

SEQ ID NO: 329377 - DNA, 620 bp, Homo sapiens
  misc_feature: GZ8MTXP02GQR3K.51.76.G10.1.454.CMB.2.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggacttcaccttnagtgcctagtggcatgcacgtggggtccnccaggcctccgaggcgaaggggctggaggtgggtgctagtttanatcagtatgagtggataagtaaagtaggntagtcgactagtcgtacggtaggaacggtcctactaccactactcctacgaacgaactaactaacctaccgaaacgaaaccactacgttacgtactacgtaacgaactaaagtacgaaacgtagtacgtaggaagtacgtacggtaacggacgggaacgtacggtcgttacggttacgtttacgtttacggtaggtaacgtaaacggtaaacgtacgttaaggtacgggtaacggggttaggggtaaggg

SEQ ID NO: 329378 - DNA, 496 bp, Homo sapiens
  misc_feature: GZ8MTXP02HC5TQ.51.76.G10.1.454.CMB.2.raw
  modified_base (149)..(149): a, c, t, g, unknown or other
  misc_feature (149)..(149): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (260)..(262): a, c, t, g, unknown or other
  misc_feature (260)..(262): n is a, c, g, or t
  modified_base (265)..(265): a, c, t, g, unknown or other
  misc_feature (265)..(265): n is a, c, g, or t
  modified_base (267)..(269): a, c, t, g, unknown or other
  misc_feature (267)..(269): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (308)..(309): a, c, t, g, unknown or other
  misc_feature (308)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (331)..(333): a, c, t, g, unknown or other
  misc_feature (331)..(333): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacagggggagaggagcccagcactagaagtcggcggtgtttccattcggtgatcagcactgaacacagaggactcaccatggagtttgggctgagcgtggtttccncgttagctctttaagaggtgtccagtgtcaggtgcagctggtggagtcgtgggggagcgtggtccagcccgggaggtccctgagactctcctgtgcagctctgntcnctcnnnctngnnncnctgcgcngcncngngaggngngngtggngntatntannanangagngnanaananagtannngtcgtcgtagagacgactcacactcacacgagaacaactaccacgaacacactatatactaganaanagaanaagtagtagagagacgtacgacggacgacgtacgtacgtacgttacgttcgtagtaagtacgaacgtacgtagtaggtaggtagggtaggg

SEQ ID NO: 329379 - DNA, 547 bp, Homo sapiens
  misc_feature: GZ8MTXP02HOWZJ.51.76.G10.1.454.CMB.2.raw
  modified_base (344)..(344): a, c, t, g, unknown or other
  misc_feature (344)..(344): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctcctgtgcagcctctggattccacttcagtgcctatggcatgcacgtgggtcccgccaggcctccgagggcaagggggctggggagtggggtgctatttanatcagtatgagtggactagtaaataaagntactgacagtctcgtagaggcgattcacatcncagagacaactccaagaacacgactagtactctagacaaatcgaaacagtattagaagtacgacgtaggaacgaccgacggtcgtacggtttgttacgttcgtacggtacggaacgtaaacgtacgttaaggtacggtaggg

SEQ ID NO: 329380 - DNA, 600 bp, Homo sapiens
  misc_feature: GZ8MTXP02F2BES.51.76.G10.1.454.CMB.2.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccaggaccgggagtccctgacgactctcctgtgcagcctcgtggacttcaccttcagtcgcctatggcatcgcacgttcggccnccgaggcctccggaggcgaaggggctggaggtgggtgctagtttanacngagntgagtggataagtaaagtaaagtagtancgacgtacgtcgtacggaggacggcctactaccactactcctacgaacgtaacgaacctaactacccaaacgtaaacctacgtacgtacgtactacgtaacgaactaaacgaacgtaaagagtagtagaagtacggacgtacggacggtacgtacggtacgttagttacgtttacgttcgtagtaccggaacgtaacgtcgtaaggtaggtaagggg

SEQ ID NO: 329381 - DNA, 688 bp, Homo sapiens
  misc_feature: GZ8MTXP02IYE3G.51.76.G10.1.454.CMB.2.raw
  modified_base (167)..(167): a, c, t, g, unknown or other
  misc_feature (167)..(167): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccaggcccgggaggtccctgagactctcctgtgcagcctctggattcaccttcagtgcctatggcatcggcacgtggggtccnccagggctcccgaggccgaaggggctgggaggtggggtcggctaatttanatcagatgagtggacaagtaaataaggngttaatcgctagtccgtaccggtaggaaacggggccgtattaccgaacctattacccgtacccgaagaacgtaaacctaaaccttacccaaacgtaaacccaaacctaaccgttacggttaactacgttacggaaacctaaaacttagaaaaccgtaagtaacgtttaaggaaaggtaagaccgttaaggggaacgggtaaaccggaacccggggtacttcgggtttagtttaacgttttccgttaggtaacggtaaccggtaaaaacggtcttaaggtttacggtaggggtttacgggggtttaaaaggggg

SEQ ID NO: 329382 - DNA, 631 bp, Homo sapiens
  misc_feature: GZ8MTXP02JX8Q3.51.76.G10.1.454.CMB.2.raw
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcgaccttcagtgcctatggcatgcacgtcgggtccnccaggcctaccgaggcgaaggggctgggaggtggggtgctagtttaanatagagtagtgagtaggaactaaagtaaagtagagtagtcgacgtacgttaccgtacggtagggaaccgggtaccgtacttaccaacctactaccgtacgaacgaacgtaacctaaccgtacccgaaacgtaacctactacgtagtactacgtacgaaactaagtacgaaacgagtagtaggacgagtacgtacggaacgtacggtacggtgttacgttacgttacgtttacgtacgtaacggtaacgtaacgttacgtaggtaggtaggggtaacggggttaaggg

SEQ ID NO: 329383 - DNA, 757 bp, Homo sapiens
  misc_feature: GZ8MTXP02F0YMT.51.76.G10.1.454.CMB.2.raw
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggaggcgtggtccaggcccgggaggtccctgacgactctccgtgtgcagcctcgtggacttccacctttcgagtcgcctagtcggcagttcgcgtacgtcggggtccccgaccacggggtcctcccgagggcggaaacgggggtctaggggtagggttggggtcggtacttaagttttaagtacgttcgaaggtagttcgaagtttcggggaaacttaaaaggttaaaaagttaagggacgttaaagtgaccgtaggttccgtaccgggtagggtaaccggggtaccttaacgttacctaaaccactttaccgtaaccgacggtaaactaaaccctaacctaaacccgaaacgtaaaaccgaccttaacgttacgtaagttactaacggaaactaaaacgtaggaaactaagtaagttagaagtacggtagtacgggaaacgtaccgtaacggtcgttacggtttaacgtttaaccggtttcgtaggtaaccggtaaacgtaaaaccggttcgtaaggtacggggtaacgggggttacggggtttaaaaggggg

SEQ ID NO: 329384 - DNA, 575 bp, Homo sapiens
  misc_feature: GZ8MTXP02GWXKV.51.76.G10.1.454.CMB.2.raw
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggccnccaggcctccgaggcgaaggggctgggaggtggggtgctagtttanactcgagtatgacgtggacaggtaaataaaaggagttactgacaggttccgtacgtaggaacggggcctagttccaacctattcccaccgaagaacgaacctaacttacccgaaagaaaccactactagtatccgtagaacaaataggaaactagtagtagaagtaagcgtaggaacggacgacggtcttggtacttatttcgagtacgacgaaacgtcttagaggtaagggg

SEQ ID NO: 329385 - DNA, 583 bp, Homo sapiens
  misc_feature: GZ8MTXP02HLKAJ.51.76.G10.1.454.CMB.2.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccacggcccgggagtccctgagactctcctgtgcagcctntggattcaccttcagtgcctatggcatgcacgtgggtccncgaggctccgaggcgaaggggctgggagtgggtgctattttanactcgagtctgagtggactaagtaaataaagtagttacgagtaacgtcgtacggagggaaacgggtcctacttccgacctaatccgtaccgaagaacgtaaccaacttaccccgaagaaacccanaacgttgtataccctagaaccaaagtgaaacagtagtagaacgngtcgagaggacgacgggttctcgttacgttattcgaaggtacgaacgtactacgtaggtaggtagggtaggg

SEQ ID NO: 329386 - DNA, 587 bp, Homo sapiens
  misc_feature: GZ8MTXP02F9QV9.51.76.G10.1.454.CMB.2.raw
  modified_base (254)..(254): a, c, t, g, unknown or other
  misc_feature (254)..(254): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgccctctgctatagtattggatacaactnttggattggcacctgcaagagccagggcagtctccagacggtctagatcttattgagttcgtaacggtcccccggggaccccccggggtctagacgtaggttcgagtggctaggtggatcgaggactacgagtatttatactaagaaatgagtacgaggagtagggagtcgtaggaggtagttgggtttagggtttaatcgtagttcggtatagttagacgtaagaccttactaaactaaaccttccgtacgttacgtaccggtttacgggacgggtaacgggtaacgtaagggtaaggacgtaagtacggaagtacggtaacgtaggtacgg

SEQ ID NO: 329387 - DNA, 604 bp, Homo sapiens
  misc_feature: GZ8MTXP02IFGBS.51.76.G10.1.454.CMB.2.raw
  modified_base (196)..(196): a, c, t, g, unknown or other
  misc_feature (196)..(196): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgtagcagcgacttagcctggtaccagcagaaccnggaccaggcctcccgagcctcctcatctatnatgcatccaagaacggccacgtgactactcccagcctaggttcaggtgactaggtcggtctggggactaggtacgtttccacgttcctaccaaccactacacgacacgcctgctagtcgtagtaagttatttagtacttaatttattacttagttactacgtactaagttaattaacgttaacgtacgttaccgttacgttaccttaacgtttttacgggaccggtaacggggtaacgtaaacggtacggtacggtacggtaactaaccgaaaacgtaccgtaggtacggtacgtacgtaccgtaccttacg

SEQ ID NO: 329388 - DNA, 620 bp, Homo sapiens
  misc_feature: GZ8MTXP02HXZHV.51.76.G10.1.454.CMB.2.raw
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (521)..(521): a, c, t, g, unknown or other
  misc_feature (521)..(521): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctcgtgacttccaccttcagtcgcctagtcggcagtgccacggtcgggtcccaccgaggtccctaccgagggacgagggggtcgtagggagggtggggtagactatttanatacgagattagacgtggataagttaaaataagngttatcgactacgttcgtaccggtagggaaacggtcctacgtacactactcccgtacgaagtaacgaactaacgtacccaaacgaaactactaacgttagttactacgtagaactaaagtacgaanagtatagagagcgtacggacgtacgacgtgttggttacttacgtttgtacgtaacgtaacgaaacgttcgtaagtacggtacggggttaggggtaaggg

SEQ ID NO: 329389 - DNA, 619 bp, Homo sapiens
  misc_feature: GZ8MTXP02J1OUI.51.76.G10.1.454.CMB.2.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggaggcgtgggtccaggcccgggaggtcccctgacgactctcctgtgcagcctctggattccaccttcagtcgcctagtggcatgcacgtgggtccnccagggcctccgaggccgaaggggctgggaggtggggngctatttanatcagatgagtganaagtaatagngtangnagtcgtcgaggacggcatcacntcacgagacaacactaccaacacactactagtactnacgaactaaagtacgaaacgtaggtaacgttaggaacggtacggtacggtaacgggaacggaccggtacgggttacgttacggttacgtttacgtttaccggttagggtaaccggtaaaccggtaaaaccgttacggttaagggtacggggtaacgggggtttaagggggttaaaggggg

SEQ ID NO: 329390 - DNA, 572 bp, Homo sapiens
  misc_feature: GZ8MTXP02F5EX7.51.76.G10.1.454.CMB.2.raw
  modified_base (162)..(162): a, c, t, g, unknown or other
  misc_feature (162)..(162): n is a, c, g, or t
  modified_base (269)..(269): a, c, t, g, unknown or other
  misc_feature (269)..(269): n is a, c, g, or t
  modified_base (338)..(338): a, c, t, g, unknown or other
  misc_feature (338)..(338): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctnttttaagaggtgtccagtgtcaggtgcagctggtggagtcgtgggggagcgtggtccaggcccgggagtccctgagactctcctgtgcagcctctggattcaccttnagtgcctatggcatgctacgtggtcccgcaggctccgaggcgaaggggctggaggtgggtgctatttantcagtatgatggactagtaaataaagagttatgacgtagtcgtccgtagaaggccgtatacaccgtatcctacgaagacgactaactacccgaaanaaccactactacgtatactacgactaaaacgtagaaacagtaattaggaagagacgtaggaacggacgaaccgggtcgttcgttagttagtttcgtacggtacgtaaccggaaaaggtccgtaaggtaggtaaggggg

SEQ ID NO: 329391 - DNA, 763 bp, Homo sapiens
  misc_feature: GZ8MTXP02F5TNT.51.76.G10.1.454.CMB.2.raw
tcagcgatcgtatacacgaccggtgctcgatttagtcactcatacaggggtgatcaggactcctcagttcaccttctcacaatgaggctccctgctcagctccgtggggctgctaatgctctgggtctcgtggatccaggtggggatattgtgatgactcagtctccactctccctgcccgtcacccgtggagcgccgcctccatcctcctgcaggtctagtcagcgtcctctgactagtagtattgatacaattagttagattcggcacctgacaagagccgagggcacgtcctccagtcggtacctagtacttcgtttaagttgacgtttaccgtaacggtcccccccggggtacccccccggttctaggtaccgttaggttccgtaagggtcgggacgtaggggttcggacttaccgggacgtcgtaaactagtttaattttaacgaacgttaaagaaaacgttgaaaccggacgaaagggttacgggtaggggaccgggttacgttaaaggggttaagggttagggtttttacgggggtttttagggtttaccgttacgggttaagtttaacccggacgttaaggttaccgggaacttaaccggtacccctttaacgttaaaacccctaaaccgtttcccgttaaaccggttaaccgggtttacccgggttaccggggtaaaccggggaaccggttaaaccggttaggggaacggtaacgtacggtaacggaacggtaaaccggtagtcgggttaccgg

SEQ ID NO: 329392 - DNA, 577 bp, Homo sapiens
  misc_feature: GZ8MTXP02GEWPP.51.76.G10.1.454.CMB.2.raw
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctcatctcctgcaggtctagtcagacgtcctcctgcatagtattggataactaactagttggattggcctaccgtgacaagaacgcgagggcagtcctccagnggtcctagattcttattgagttactaacgtcccccggggcccccggtcctagacgtggtcagtggcagtggactgagcactagttatttanactaagaaaactcgaagcgaaggtaggtagggagngtaggaggtagtttcgggtttagggtttactagtaagttgatagtaggactagaccttacaaactaaacttccctagtacgtaaccgtttcgggacgggtaacggaccgtaaagggtaaggacaagtaccgaagtaccgaacgttggtacg

SEQ ID NO: 329393 - DNA, 814 bp, Homo sapiens
  misc_feature: GZ8MTXP02IM7ZZ.51.76.G10.1.454.CMB.2.raw
  modified_base (631)..(631): a, c, t, g, unknown or other
  misc_feature (631)..(631): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggtccaggcccgggagtccctgacgctctcctgtgcagcctctggacttcaccttcagtcgcctagtggcagtcgcctacgtcggggtcccaccgacgggccctaccgagggaccggaagggggtctagggggacgggttgggggtacggtaccttaaagtttttagacgttacgaaggtagttgggtaagttcggggaaacttaaaaggttaaaaagtaaaggggtagtttaaacggttacggaacccgttaacgggtttcccggttaccgggggtaagggtaaacccggggggtcccttaaacgtttacccgaaacccgttacttacccgtaacccgaagggtaaacgtaaacccctaaaacctttacccccgaaaacgtaaaccctaaaccgtaaaccgttacggttttaacncccggttaaggaaaacctaaaagttaccggaaaacgtagtaacggttaggaaggtaaagtccgtaaggggaaacggaccgtaccggggttactttacggttacggtttaatttccggtaggttaacggaaaccgtaaaccgtcgttaaggtacggggtaaggggtacgggggtttaaaggggg

SEQ ID NO: 329394 - DNA, 581 bp, Homo sapiens
  misc_feature: GZ8MTXP02JONDK.51.76.G10.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccacctctcctgcagggccagtcagtagtgtagcagcgtacttagcctaggtaccagcaagaaacctggaccaggcctcccgaggcctcctcatctangatgcactccgaacgaacggcccatgactactcccgaaggtcctagggttcaggtcgacgtagggtcgggtacgtgggggacaggtacgttccacgttacnccaacctatcgagcacggcctggactggtacgtagtaacgttatttacgaactttaagttttattactagtacctaggtactaagttaataactacgtcgtaccttacgtacttacgtttcggacgtacgggactagcgtagacgtaacgtacgaaacgtacgtaggtcgactacgactactacg

SEQ ID NO: 329395 - DNA, 593 bp, Homo sapiens
  misc_feature: GZ8MTXP02JK16I.51.76.G10.1.454.CMB.2.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtcgtgggggagcgtggtccaggcccgggaggtccctgagctctcctgtgcagcctntggattcacttcagtgcctagngnatgcacgtcggccncgngcncgaggcgaggcgtggaggtgggtgtacttatttanacgtgagtatagtacgtggaactaagtaaagtaaaggtagttancgacgtacgttccgtacggtagaacggtcctataccacctagtccacgagtaacaactaactacccgaaagtaaccactagttacgtactacgagaacgtaactaacgtaacgtaagtagtagtagacgtacgtaggacggtaacggtacggtacgttacgttacgttagttaacgttacggtacggtacggtaacgtacgtacggtacggtaggg

SEQ ID NO: 329396 - DNA, 561 bp, Homo sapiens
  misc_feature: GZ8MTXP02FNE46.51.76.G10.1.454.CMB.2.raw
  modified_base (266)..(266): a, c, t, g, unknown or other
  misc_feature (266)..(266): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggaggcgtggtccagcccgggaggtccctgagactctcctgtgcagcctctggattcaccttnagtgcctatggcatgcactggggtcccgccagggcctccgagggcaagggggctgggaggtggggtggctatttatatcagatgatggacaagtaataagagtatgcagtctccgtagaaaggggccgtattccaccatctaccagacgaacaattccccaagaaaccacactagtatctagacaaatgaaacagattagagagacgtaggaaggaccgaacggcttaggtagttaactttcgtgtaacggaacgaaaaccggtcttaagtaggtaaggttagggggtaaagggg

SEQ ID NO: 329397 - DNA, 532 bp, Homo sapiens
  misc_feature: GZ8MTXP02FJ8B6.51.76.G10.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttagcagcgacttagcctggtaccagcagaacctggccaggcctcccaggctccnatctatgatgcatccanaagggccatgatacnccagccaggttcagtgcagtgggtctggggacagtagttcactcncacatcagcagcctgcagtctagaagtatttgtactaatttattactgtacagactaagtaataataaacgtcggtacctaccgtactacgttttacggccgtagggggacctaaggacgtaggtaactactaacgtaaacggtaacgttggtacgtctacggaccaccttag

SEQ ID NO: 329398 - DNA, 594 bp, Homo sapiens
  misc_feature: GZ8MTXP02F30GZ.51.76.G10.1.454.CMB.2.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggctcctcatctangatgcatccacgaagggcccacgtgactacncccagcctaggttcagtggctaggtggggtctggggacaggtacgttcactctacaccatcagcacgcctgcagtctagtaagtatttgacttaaatttattactgtacagtactaagtattaaagtaactacggtaccttaccgtaacttaccgttttacgggaccgtaaacgggggtaaaccaaacggtaccgttacgggaaacgtaacgttaaaccgaaaaaccgtaaaacgtggttacgggaccttacggacctaacccggttaacg

SEQ ID NO: 329399 - DNA, 618 bp, Homo sapiens
  misc_feature: GZ8MTXP02JEL2J.51.76.G10.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttnagtgcctatggcatgcacgtggccnccaggctcgaggcaaggggctgggagtggggtgctagtttanactgagtatgtagtggaactaaggttaaagtaaaggtagttagtggacgtacgttcccgtaccgggtagggtaaacggggtcccgtaacgttacccacccgtactacccgtaccgaacgaacgaacctaaccgtacccgaaagaaacctactacgtacgtactacgtagaacaaaagtacgaaacgtaagtaagtaggaagtacgtcgtaaggacggaacgacggtcgttaggttcgttacttcgtacggtacgaacgtaaacgtcgtaagtaggtaaggg

SEQ ID NO: 329400 - DNA, 560 bp, Homo sapiens
  misc_feature: GZ8MTXP02GFVAC.51.76.G10.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggctcctnatctatgatgcatccagaacggccactgatacnccagccaggttcagtggcaggttcgggtctggggacaggtacgttcactctcaccatcagcagcctgcagtctagagttatttgacttaaagtttatacttgtacagtactaagttaattaaacttaccgtacgtcccgttaccgttaacgttacgtttttacgggaccggtaacggggtaacctaaaggtccgtaggtacgaagttaacgaaacgtaacgtagtcgacgtacggcacctacg

SEQ ID NO: 329401 - DNA, 559 bp, Homo sapiens
  misc_feature: GZ8MTXP02F6PG8.51.76.G10.1.454.CMB.2.raw
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (463)..(463): a, c, t, g, unknown or other
  misc_feature (463)..(463): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagacctctcctgtgcagcctntggattccaccttcagtcgcctatggcatgcacgtgggccncaggctccgaggcgaaggggctgggaggtgggtgctatttanactcagtatgagtgganagttaaanaaagngtatgactaggtcctcggtagaacggcctattacactatccacagacactaactacccaagaacactatgtactctagaactaaatgaaacngtataggagacgtacgaggacgggacctacgggtacttaggttagtttaacgtttgacggtacggaaccgtaactacgttacggagggttaagggg

SEQ ID NO: 329402 - DNA, 674 bp, Homo sapiens
  misc_feature: GZ8MTXP02GTBCT.51.76.G10.1.454.CMB.2.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctcgtggattccaccttcgagtgcctatggcatcgcacgtcgggccncaggctccgaggcgaaggggctggaggtgggngctaagtttanagtnaagtntgtagaggacgtaaagttaaaataagngtagtcgacgtacgtccgtacgggtaggaaacgggtcctaacttaccaacctacgttacccaaccgaagaacgtaactaaaccttaccgaaacgaaacctaactaacgttagtaacgtacgtaacgaaactaaagtacgtaaacgtaagtaagttagaaacggtacgtagtaacgggaaacggtaacgtaccggttagttacggtttacgttaaccgtttcggtaacggaacggtaaaacccgtaaacgtacgttaaggtcgggggtaacgggggtttaaaggggttaaaggggg

SEQ ID NO: 329403 - DNA, 546 bp, Homo sapiens
  misc_feature: GZ8MTXP02JR1JC.51.76.G10.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaaacctggccaggctcccaggctcctcatctatgatgcatccacaagggcccatgatatcccagccaggttcagtgcagtggtctggggacagagttcactctcaccatcagcagcctgcagtctgaagtattttgactaatttaatactgtctagcagtaataataaactggtacctccgtaactacgttttacggaccgtaacgggggacccaaaggtccgttacgggaagtaacttacgaaaaaccggtaaacgtacggttagggacttcggacctaaccctaacg

SEQ ID NO: 329404 - DNA, 574 bp, Homo sapiens
  misc_feature: GZ8MTXP02GDT04.51.76.G10.1.454.CMB.2.raw
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (518)..(518): a, c, t, g, unknown or other
  misc_feature (518)..(518): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcccgggaggtccctgagactctcctgtgcagcctctggattcaccttcagtgcctatggcatgcacgtgggtcccnccagggcctccgaggcgaaggggctgggaggtggggtggctagtttaanatcgagtagtgagtggactaaagttaaagtaagtagtatcgacgtacgttcgtaccgggtagggaacgggtccgtactccacctatcccacgaagacaactactaccaagaaccactactntatactagacaaanagaaacagtagtagagagtacgaggacgacgtacggtntacgttagttacttcgtagtaacgaacgaacgtgtagtaggtaggtaggggtacgg

SEQ ID NO: 329405 - DNA, 598 bp, Homo sapiens
  misc_feature: GZ8MTXP02FO0HS.51.76.G10.1.454.CMB.2.raw
  modified_base (341)..(341): a, c, t, g, unknown or other
  misc_feature (341)..(341): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctcgtggacttcaccttcagtgcctatggcatgcacgtggtccgcaggcctccgaggcgaaggggctggaggtgggtgctagtttanactgagtagtgagtggaatagtaaataaagtagtangtactacgtcgtacgtaggaacggtcgtactaccactactcctacgaagactaactaacctaccgaaacgaaacctactacgtagtactacgtaacgaactaaagtacgaaacgtagtaacgtagaacgtacggtacgtaaggaacggaacgtaacggtcgttacggttagttacgttaacgtacggtaacgaacggtaacgtacgtaggtagggtaaggg

SEQ ID NO: 329406 - DNA, 561 bp, Homo sapiens
  misc_feature: GZ8MTXP02FOR52.51.76.G10.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagcctggtaccagcagaacctggccaggctcccgaggctcctnatctatgatgcatcccaacgaacgggcccagtgaatactcccaggcccaggttcagtggctaggtcgggctgggggacaggtacgttcacctctaccacatcagcacgctgcagtctagagtatttgacttaatttattacgtgtactagtactaagttaataacgtacgtacgtacccttacgtacgttacgtttcggaccggtaacggggtaccaggtacgttaggacgtaacgtaaacgaaaacggtacgtggtacggacgtcgacacctag

SEQ ID NO: 329407 - DNA, 577 bp, Homo sapiens
  misc_feature: GZ8MTXP02FZHEB.51.76.G10.1.454.CMB.2.raw
  modified_base (300)..(300): a, c, t, g, unknown or other
  misc_feature (300)..(300): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (493)..(493): a, c, t, g, unknown or other
  misc_feature (493)..(493): n is a, c, g, or t
  modified_base (544)..(544): a, c, t, g, unknown or other
  misc_feature (544)..(544): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggaggcgtggtccaggcccgggaggtccctgagctctcctgtgcagcctgtggattccaccttcagtgcctagtggcatcgctacgtcgggtcccnccgaggcctaccgaggccggaaggggctgggaggtggggtgtctagtttanatcgaagngtgatcggataagtaaanagngtagtgcgtacgtcgtacggagaaccgggctatcaccatcctacgagaacgacctaactacccaagaaccacgtactagtactctagaacctaaatagaatagtatagaacgngtaggagaccgtagtcgtgtagttacgttcgtaggtacgaacgtaaacgtnttaggagggtaggtaggggtaagggttaagggg

SEQ ID NO: 329408 - DNA, 745 bp, Homo sapiens
  misc_feature: GZ8MTXP02I323W.51.76.G10.1.454.CMB.2.raw
  modified_base (155)..(155): a, c, t, g, unknown or other
  misc_feature (155)..(155): n is a, c, g, or t
  modified_base (174)..(174): a, c, t, g, unknown or other
  misc_feature (174)..(174): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (374)..(374): a, c, t, g, unknown or other
  misc_feature (374)..(374): n is a, c, g, or t
  modified_base (544)..(544): a, c, t, g, unknown or other
  misc_feature (544)..(544): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttccncgttgcttcttttaaaggnggtgtccagtgtcaggtgcagcgtgggtggagtcggtgggggagcggtggtccgaggcccgggagtcccgtagagtactctcgtgtcgcngcctgtggntcnccttnagtcgctagngcatcgccagtcgggtcccacgacggtcctaccggagggaccggaaggggtctaggggaggttcggggtcgtacttagtttanaccgtagagtgtagagtagaacgtaagtaaacgaaaggtacgttacgcgacgttcgtaccgtacgggtaagggtaacccggtcttacctacccgaaccgtctaccccgaaacgaacgtaaccgtaaaccttaacccgtaaacccgaaacgtaaacctaccttacgtacgnttacgtaccgtaaacgtaaacgtaaacgtaaacggtaaacgtaacgtaagtaacggaaacggtacggtaacgggtaacgggtaaacgggtaaaccgggttaccggttacggttacggtttaacggtttaaccggtttaacggtttacggttaacgggtaaaaccggtaaaccggttaaacggtttaaacgggttaacgggg

SEQ ID NO: 329409 - DNA, 602 bp, Homo sapiens
  misc_feature: GZ8MTXP02JNJ0Q.51.76.G10.1.454.CMB.2.raw
  modified_base (388)..(388): a, c, t, g, unknown or other
  misc_feature (388)..(388): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtgggtccaggcccgggaggtcccctgagactctcctgtgcagcctctggattcaccttcagtgcctatggcatgccacgtcgggtcccgccagggcctccgagggccgaagggggctaggggtaggtcggggtggcctaagtttacagtcaggattgatggactaagtaaatagngtatgactagtcgtcgagacggcatcaccatcacagacgacaacgtcccaagtaaccacacgttgtactactagaacctaaatcgaaactaggtaattacggaaagtacgaccgtaggaacgggaccgtaaccgggtcgttacggttacggttactttcgtaggttaacgaacgttaaaccgtctaaggtggtacggggtaggggttaaagggg

SEQ ID NO: 329410 - DNA, 545 bp, Homo sapiens
  misc_feature: GZ8MTXP02F0VRT.51.76.G10.1.454.CMB.2.raw
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtgcagcctcgtggattccaccttcagtcgcctagtggcatgccacgtgggtcccgccaggcctccgaggcgaaggggctgggagtggggcggtctagtttatatcagatgatggacaagtaaataggntatgcagtcgacgtggaaggccgatcacatctacagacacactaccagaacacactagtactctagaactaaangaacagtatagagacgagtaggacggacgtacgtagtgttacgtttagttcgtaggtaacgtaaccgaagtacgtagtaggtacgggtagggttaaggg

SEQ ID NO: 329411 - DNA, 626 bp, Homo sapiens
  misc_feature: GZ8MTXP02FRKUK.51.76.G10.1.454.CMB.2.raw
  modified_base (186)..(186): a, c, t, g, unknown or other
  misc_feature (186)..(186): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (559)..(559): a, c, t, g, unknown or other
  misc_feature (559)..(559): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggagtccctgagactctcctgtncagcctctggattcaccttnagtcgctagtggcatgccacgtcggggtccccgccgacgggtccctacccggagggccggaagggggcctaggggacgggtggggtggactaagtttatatcgagtatgactggacaagttaaataaggactagtgactacgtcgtaccgggaggaaacgggtccgtattccaaccgattaccctacccgaggaactaacctaacttaccccaaagtaaacctaactacctagttaacctctacgaaactaaagtacgaacagtagtagagtacgacgtaggacggtaccgnggtacttggtacttattcgtagaacggtaacgtaacgtcgtagtaggtagggtagggtttaacgggg

SEQ ID NO: 329412 - DNA, 549 bp, Homo sapiens
  misc_feature: GZ8MTXP02GG58Z.51.76.G10.1.454.CMB.2.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgacgactctcctgtgcagcctctggattcaccttcagtcgcctatggcagtgcacgtcgggtccgccaggcctccgaggcgaaggggctgggaggtgggngactatttanatcagatgatgganagtaaanaaagngtangactagtctacgtagaacggcgtacttcacctatcctacgaagacaacaacttacccaaagaaaccactactagtactctacgaactaaagtacgaactagagttaggaagaagtcgaggacgtaccgaggtctagttgttacttgtagtacgaccgaagtctagtggtaaggg

SEQ ID NO: 329413 - DNA, 544 bp, Homo sapiens
  misc_feature: GZ8MTXP02FJWKG.51.76.G10.1.454.CMB.2.raw
  modified_base (341)..(341): a, c, t, g, unknown or other
  misc_feature (341)..(341): n is a, c, g, or t
  modified_base (446)..(446): a, c, t, g, unknown or other
  misc_feature (446)..(446): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccctgagagccggcctccatctcctgcaggtctagtcagacgcctcctgcatagtattggatacaactattggatggcacctgcagaagccagggcagtctccacaggtcctgatcttatttgagtttctaacgtcccccggggccccccggggttcccngtacgacgggttccaggttggcctaggttggactcgaggacaacgtaagtattttaactactaagaaaatcaagcagagtggaggctgaggtatgttagggtttntcgattgcatgcaagctacaacaacctcctagtacgacgttcgggacggaacgggaccgaaagggtaaggacgacgtacgaacgtcgaaactggtcgg

SEQ ID NO: 329414 - DNA, 519 bp, Homo sapiens
  misc_feature: GZ8MTXP02I2Q3R.51.76.G10.1.454.CMB.2.raw
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgccctcctgcatagtatgatacatattggattgcactgcagagccagggcagtcctaccagtacggtcctgattcttagtttgagttctacgtcccccggggcccccgggtcctgacgtagttccagtggcaggtggactcgaggcactagtattttagactaagaaatcagcgagagtaggagntaggaggtgttgggtttgggttancgtattgnatgactagctactaactaactctatcgtacgttcggacggacgacgaggtgaagtatacgagacgtaacgtgtacg

SEQ ID NO: 329415 - DNA, 682 bp, Homo sapiens
  misc_feature: GZ8MTXP02JIP5F.51.76.G10.1.454.CMB.2.raw
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcacttcagtgcctatggcatgcacgtgggtcccnccagggcctccgagggccgaagggggctaggggtacggtggggtggtcctaagtttttanactcgaaggtactggtactggggactaaaggttaaaataaggggnttaacgtggacctagttaccgtccgggtagggaaacgggggtccctaattcccgacctactccgtacccgaaggaacgtaacctaacttaccccgaagaaaccacctaacgttagttactcgtagaactaaaagtcgaaaacaggtaattaggaaggtagtaccgtaggggaaccggtacgtaacccgggggttcttacggttacgtttacgtttcggtacggtaacggtaaaccggtaaacgtcgttaaggtaggggtacggggttaacgggggttaaggg

SEQ ID NO: 329416 - DNA, 558 bp, Homo sapiens
  misc_feature: GZ8MTXP02FHRET.51.76.G10.1.454.CMB.2.raw
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttcagtgcctanggcatgcacgtgggtccccaccaggcctccgaggcgaaggggctgggagtggggngctattanatcagatgatggacaagtaaataagngtatgactgtcgcgtagacggcctatcactntcacagacaactactaccaanaaccacactgtactcgtagaacaaagtagaaatagtagtagaagacgacgaggacggacgtacggtcgttagttacgtttacgttcgtaggtaacgaaaccgtaaacgtacgtaaggtagggtagggttagggggtaaggg

SEQ ID NO: 329417 - DNA, 648 bp, Homo sapiens
  misc_feature: GZ8MTXP02JRA40.51.76.G10.1.454.CMB.2.raw
  modified_base (385)..(385): a, c, t, g, unknown or other
  misc_feature (385)..(385): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattccaccttcagtcgcctatggcagtgcacgtggtccgccaggcctccgaggcgaaggggctgggagtgggtgctagtttatatcagatcggaatgggactaagttaaagtaaaggagttacgngtccgaagttccgttaccggtaggaaacgggtccgtaacgttacccaacctagtaccaccgaaggaactaacctaaacttacccaaagaaaccctaacgtaccgttagtaacgtactacgaacttaaaacgtacggaaactaagtaacgtttaggaaacgttacggaccgtaaggggaacggtaaccgaacgggttccgttaggttacgtttaatttcgtaggttacggaaacgtaaaccgtcgtaaaggtggttaaaggggg

SEQ ID NO: 329418 - DNA, 597 bp, Homo sapiens
  misc_feature: GZ8MTXP02HE9TU.51.76.G10.1.454.CMB.2.raw
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
  modified_base (564)..(564): a, c, t, g, unknown or other
  misc_feature (564)..(564): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattccaccttcagtcgcctatggcatcgccacgtcggggtcccgccaggcctccgagggcgaaggggctgggaggtggggtggctaagtttanatcagtatgatggacaaagtaaataaggagttangactagtctccggtaggaacgggtccgtaattcgacatccctacaagagaacctaactacccaagaaaccactatagtatctagaacctaaaatcgaaatagtattagaacgagacgtaggaacggaccgacggtcgttagttacgttactttcgtagttaaggaaccgtaaaaccgtntaaggtcggtaaggggttaggggttaaaggggg

SEQ ID NO: 329419 - DNA, 673 bp, Homo sapiens
  misc_feature: GZ8MTXP02H24ZI.51.76.G10.1.454.CMB.2.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccaggcccgggaggtccctgagactctcctgtgcagcctntggattccaccttcagtcgcctatggcatgcacgtcggggtccnccgaggcctccgagggaccaagggggctagggacggttggggtggctaagttttaanagtnagatgagtggataaagtaaatagtagtacncgactacgtcgtacggtaggaacgggtccctattacccaactactcccgtacgaagaacgtaacctaaacctaccccgaaaacgaaaccacgttaaccgttagttaactacgacgaaactaaaagaaacgaaacgtaagtaagtaaggtaaggtaacgtaacggtaacggtaacgggaacggtaaccggtacggttacgttacgtttacgtttacgttacggtaacggtaaccggtaaaccggtacgttaacggttacggtaacggggttaagggggttaagggg

SEQ ID NO: 329420 - DNA, 655 bp, Homo sapiens
  misc_feature: GZ8MTXP02HNB1E.51.76.G10.1.454.CMB.2.raw
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctgacgactctcctgtgcagcctgtggattccaccttcagtcgcctatggcatgcacgtcggggtcccnccgaggcctccgaggaccgaaggggctgggagtggggtgctatttanatcagatgagtggactaaagtaaagtagtagtactgactacgttcgtaccggtaggaacgggccctaacttcccgacctacttccctacccgaaggaaacgtaaccaaaccttacccgaaagaaaccaacgtacttacgttactacgtacgaaactaaaacgtacgaaacgtaagtaagtaggaagaaggtccgtaagggaacggaaccgaccggtacgttacggttacgtttaacgtttccgtagggtaacgtaaaccggtaaaaccgtcgtaaggtacgggtaaggggttaggggttaaaggggg

SEQ ID NO: 329421 - DNA, 590 bp, Homo sapiens
  misc_feature: GZ8MTXP02GC1OK.51.76.G10.1.454.CMB.2.raw
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggaggtccctgagactctcctgtgcagcctctggattcaccttcagtgccttatggcatgcacgtgggtccncaggctccgaggcgaaggggctgggagtggggtgctaatttanatanagatgagtgataaagtaaanaagtatatcgacgtagtcgtacggtaggaacggctaatcaactatccacgagacgaacaactacccaaagaaacctactacgtagtactacgtacgaactaaagtaagaaacgtaagtaagtagtaagacgtacgtacgaacggaacgacggtacgttacggttacgttacgtttacgttaggtaacggtaacgtaaaacgtacgtagtaggtagggtagggtaaggg

SEQ ID NO: 329422 - DNA, 561 bp, Homo sapiens
  misc_feature: GZ8MTXP02IWL8W.51.76.G10.1.454.CMB.2.raw
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagcctcgtggattcaccttcagtgcctatggcatgcacgtgggtccnccaggcctccgaggcgaaggggctgggagtggggtgactagtttanatcgagtntgatggactaagtaaataggngtatcgctagtctcggtagaacgggcctatcaccgatcctacagacgacaactccaagaacacactagtatccgtagaacctaaagtcgaaactagtaattggaagcgtacgtaggacggacgacgggtacttggtcgttactttcgtacgtaacggacgtaaacgtcgtaagtggaggttaggggtaacggg

SEQ ID NO: 329423 - DNA, 674 bp, Homo sapiens
  misc_feature: GZ8MTXP02FOVYN.51.76.G10.1.454.CMB.2.raw
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagacctctctgtgcagcctctggattccaccttnagtgcctagtggcatgcacgtcgggtcccnccgaggcctccgaggccgaaggggtctggggaggtggggtggctatttanactcagtatgagtggactaaggttaaataacgngtatgactaggttctccgggtaggaaacggggtccgtaacttacccaacctactcccgtacccgaagtaacgtaacctaaaccttacccgaaagtaaacctacctaacgttacgtaacttacgtacggaaactaaaacgtacggaaactaaggtaacttagggaaacgtaggtacgtaggggaacgggtaaccgtaaccgggtcgtttacggtttacgtttacgtttcgttagggtaacgaacggtaaaacgtcgttaagtagggtaacgggtagggggtttaaaaggggg

SEQ ID NO: 329424 - DNA, 649 bp, Homo sapiens
  misc_feature: GZ8MTXP02HP2KM.51.76.G10.1.454.CMB.2.raw
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagactctccgtgtgcagcctgtgattcacccttnagtcgacctagtggcatcggctacgtcgggtcccnccgagggcctccgaagggccgaaggggtctgggagggttggggtgacttaagttttaanagtacgagtagtgagtcggaataaagttaaagtagtacgtatcgacgtacgtccgtacggtaaggaacggtcctaacttaccaacctctaccgtacgaagtaactaaacctaacctacccgaaataaacctacgtaacttacgttaactacgaagaactaaacgtaacgtaacgtaagtaagtagtagtacgtacgtacggacggacgtacgtacgttacgttacgttacgttacgttacgtaacgtaacgtaacgtacgtagtacggtacgggttagggtaaggg

SEQ ID NO: 329425 - DNA, 814 bp, Homo sapiens
  misc_feature: GZ8MTXP02F02FH.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctgacgactctcctgtgcacgcctcgtggacttcaccttcagtcgcccttagtcggctagtcgccaccggttcggggtcccgccgaggtccctccggaaggggaccggaaacggggggtctagggggtacgggtttcggggtcggtactttaaagtttttaacgtaccgttaccgaaagtagtacggtaacggttacggggaaacttaaggggtaaaaagttaaaaagggtgtttaaaacgtggggtaaacgttaaccgggttcccgttaccggggttaaacgggaaacccggggtacccgttaaacgtttacccaaaccccgtacgttacccttaaccgaaaacggtaaccgtaaacctaaacccgtttacccccgaaaacggaaaccctaaaccttaaccgttaacgttaacgttacctaaaccggaactaaaagttaccgaaaacgtacgtagttaggaacgagtaccggtaagggaacggaacccgtacgggttccgtttaaggttacgtttaccgtttaagtacgggtaaccgaaacggttaaaaccgtggtaacggttacgggttaaaggggg

SEQ ID NO: 329426 - DNA, 671 bp, Homo sapiens
  misc_feature: GZ8MTXP02JXMKH.51.76.G10.1.454.CMB.2.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctntggacttccaccttnagtcgcctagtcggcatcgcctacggtcgggtcccnccgaggcctccgaggccgaaggggtctgggagtggggtgactaatttanatacgagtatgacgtaggactaaagttaaagtaaggtagtatcgactacgttcgtacgggtagggaacgggtcctacttacccactactacctacgaagtaacgtaacctaacgtaccccaaagaaacctactaacgttacgtaactacgtacgaaactaaaacgtagaaacgtaggtaagttaggaacggacgtacggtaacgggaaacgtaccggtaaccggttcgttaggttacgtttaacgtttcggtaaggtaaccgtaaacggtaacggtacgttaaggtagggttaacggggtaggggtttaaaggggg

SEQ ID NO: 329427 - DNA, 697 bp, Homo sapiens
  misc_feature: GZ8MTXP02F8OSQ.51.76.G10.1.454.CMB.2.raw
  modified_base (169)..(169): a, c, t, g, unknown or other
  misc_feature (169)..(169): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggtccaggcccgggagtcctgagctctcctgtgcagcctntggattccacttcagtcgctagtggcagtcgccacgtcggggtcccnccgagggcctccggagggcgaagggggtctaggggtaggtggggtacgtcttaagtttatatcgaagtagtagagttgggactaaaggttaaaataagggtacgttaatcggtacgtacgggttctacccggggttaagggaaaccgggggtccctaacgtttacccaaccctacgtccgtaaccgaacgaacggtaacctaaccgttaccccgaaagtaaacccacctaacgttacggttatacccgttaaggaacctaaaacgtaggtaaactaggtaagttagggaacgaagtcgtaaggaccggtaacggtaccggtcgtagttcgtttaacgtttccgtagtaacggaaccgtaaacgtacgtaggtacggtagggtagggtttaaaggggg

SEQ ID NO: 329428 - DNA, 657 bp, Homo sapiens
  misc_feature: GZ8MTXP02JQTI0.51.76.G10.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccggggaggtccctgagactctcctgtgcagcctctggattcaccttnagtgcctatggcatgcacgtcgggtccnccgaggcctccgaggcgaaggggtctgggaggtggggtgactatttanatcagtatgatggacaagttaaataagagtatgnagttcgtaccggtaggaacgggtcccgtaattccgaacctactcccgtaccaaggaacgtaacctaaaccgttaccccaaaacgtaaaccaaccctacgttacgttaactacgtacgtaactaaaacgttagaaacgtaagtagttaaggaaggtacgtaccgtaggggaaaccgacggtaccggttacgtaggtttagttacgtttacggtaggttccggaaaacgtaaccggttacttaagggttagggtacgggttagggggtttaaacggggg

SEQ ID NO: 329429 - DNA, 654 bp, Homo sapiens
  misc_feature: GZ8MTXP02J0U4P.51.76.G10.1.454.CMB.2.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
  modified_base (597)..(597): a, c, t, g, unknown or other
  misc_feature (597)..(597): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccaggcccgggaggtccctgacgactctcctgtgcagcctctggacttccaccttnagtcgcctagtggcatcgcacgtcggtccnccgnggcctccgaggcgaaggggcgtggacggtggggtcgactagtttanactcgagtatagagtgactagtaaataaaggagtagtcgactacgttccgtaccgggtaggaaacgggtacccgtattacccgaaacccgtacttaccgtaccgtaaacggtacgaaacctaaacctttaccccggaaaagtaaacccgtaactaccgtttacgttaaccgtacctacggaaacctaaaagttaacgaaactaaggtaacgtttaggaacgtacgtacgaggaacggaccgnggtacgtgttacgttacttcgtacggacgtacgtaaacgtcgtaacgtggtaagggg

SEQ ID NO: 329430 - DNA, 657 bp, Homo sapiens
  misc_feature: GZ8MTXP02JHESI.51.76.G10.1.454.CMB.2.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccgaggcccgggaggtccctgacgactctcctatgcagcctcgtggactttcacccttnagtcgcctagtcggcatgcacgtcggtccnccgaggctccgaggcgaaggggctggaggtggggtcgctaatttagtactcgaagtatagtagtgggactaaggttaaaataaaacgggtagtaagttcggacgtaacggttcccgttaccgggtaggtaaacggggtacccgtacttacccgaacctacgtacctaccgaaggaacaaaccgtaaacttaccccgaaacgaaacctaacctaccgtagtactacctagaacctaaaagtacgaaactagtaagttacggaagaaggtcgtaagggacgggtaaccgtacggtacgttacgttgttaactttcgttaggtacgtacgaaacgtcgtaacgtaggtaagggg

SEQ ID NO: 329431 - DNA, 635 bp, Homo sapiens
  misc_feature: GZ8MTXP02I94F5.51.76.G10.1.454.CMB.2.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagctctctgtgcagcctgtggattcaccttcagtgcctatggcatcgcacgtcgggtccnccaggcctccgaggcgaaggggctggaggtgggtgctatttanatcagtatgatggactaagtaaataaggngtactggacgtacgtccgtaccgggtaggaaacggggtcctaactttcccaacctattaccctaccgaaggaactaacctaaacttaccccaaagtaaaccaacctacttacggttacttacgtaacggtaaccaaaagtaccggaaactagtaaagttggaaagagtcgtacggaacggtaaccgacgggtcttcggttacgtttatttccgaggtaacgtaacgtaaaccgtcgttagtacgggtacggggtaggggtttaaaagggg

SEQ ID NO: 329432 - DNA, 601 bp, Homo sapiens
  misc_feature: GZ8MTXP02GFKDS.51.76.G10.1.454.CMB.2.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (556)..(556): a, c, t, g, unknown or other
  misc_feature (556)..(556): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctgagactctcctgtgcagcctntgattcaccttnagtgcctatggcatgcacgtcgggtcccgcaggcctccgaggccgaaggggctgggagtggggtgctagtttanagtacagtatgagttcggggactaaaggttaaataagggtagtagtcggactacggttaccctacgggttaggaaacggggtcccgtaactttcccgaaccgtacgttccctaccgaaggaacgtaaccctaaacttaccccgaaagtaaaccaactacttagtactacctagacctaaatcgaaacagtaattgagagcgtagacgaacgcgngttcgtgttacttgtagtgacgaactctagtgaggtaggtaaggg

SEQ ID NO: 329433 - DNA, 575 bp, Homo sapiens
  misc_feature: GZ8MTXP02INUAB.51.76.G10.1.454.CMB.2.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (495)..(495): a, c, t, g, unknown or other
  misc_feature (495)..(495): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctcctgtgcagcctctggattcaccttcagtgcctatggcatgctacgtcgggtccnccgaggcctccgaggcgaaggggctgggaggtgggtgctatttanactnagatgatggacaaagttaataagngtatcgactagtcgtacgggagacgggcgtattccgacctatcctaccgagacgaactaactacccgaagaaaccactactacgtactcgtagaactaaagtacgaactagtacgtagaacgagngtacggagacgacggtacgttgttacgtttacgttgtaggtaagacgtaacgtctaggtaggtaggtagggtttaagggg

SEQ ID NO: 329434 - DNA, 553 bp, Homo sapiens
  misc_feature: GZ8MTXP02JUO8S.51.76.G10.1.454.CMB.2.raw
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (430)..(430): a, c, t, g, unknown or other
  misc_feature (430)..(430): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgcccacccctctcctgcagggccagtcaggagtgttagcagcgacttagcctggtaccagcagaaacctggccaggcctcccaggctcctnatctatgatgcatccanacgggccatgatacncccagccaggttcagtcggacaggtgggtctggggacaggacttcactctcacatcagcacgcctgacacgtcgtagtaagtatttgtacttaatttattactgtanagtactagtataataacgtcggtcctacgtactacgtttcggaccgtacggggaccgaagtccgtaggacgacgttaaccgaaaacggtaacgtacggtacggtacgtacgtaccgactaacg

SEQ ID NO: 329435 - DNA, 520 bp, Homo sapiens
  misc_feature: GZ8MTXP02JGCXU.51.76.G10.1.454.CMB.2.raw
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccggggaggtccctgagactctcctgtgcagcctctggattcaccttcagtgcctatggcatgcactgggtccnccaggctccaggcaggggctggagtggggtgcatttanatcagntgatggcagtaanagntatgcagtctcgtgaaggccgatcacatctaccagagacatcccagaacacactgtacnctgactaatgaaacngaattagagaacgngtagaggacacgggctggttgttacgtttcgtagttcgaccggtaaaacgtctaagtaggtacggtgggtttaaagggg

SEQ ID NO: 329436 - DNA, 746 bp, Homo sapiens
  misc_feature: GZ8MTXP02JVLGM.51.76.G10.1.454.CMB.2.raw
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctctgtgcagcctcgtggattcaccttnagtcgcctagtggcatgacctacgtcggggtcccnccgagggcctacccgaggccgaaggggtctagggaggtggggtcgactaagtttanagtacagatgacgtgggacaagttaaaataaggagttaactggtaccgtaaggttcctacccgggtaaggggaaaccgggtacccgtaattacccgaacctacttacccaacccgaaggaaaccgtaaacccgtaaaaccctttacccccggaaaactaaaaccccgaacttaacccgtttaggttaacctttacccgtaagggtaaaacccttaaaaggtaaccggtaaaacgtaaaggttaacgttagggaaacggtaacggtacggtaacgggtaaacgggaacccggtacgggttacgtttaggtttacgttacgtttacggtaggtaacggtaaccgtaaacggtacgttaaggtacggggtaaggggttaggggttaaaggg

SEQ ID NO: 329437 - DNA, 647 bp, Homo sapiens
  misc_feature: GZ8MTXP02JLJMI.51.76.G10.1.454.CMB.2.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggattcaccttcagtcgcctatcggcatcgcacgtcgggtccnccaggcctccgaggcgaaggggctggagtggggtagctagtttanatcgagtatgatggactaagtaaagtaaggngtactgtacctagtcgtaccggtagggaaacgggtccgtaaacttcccaacctattaccctaccgaagtaaccgaaactaaaccttaccccaaaggtaaaccaccgtaacgtacgttaactccgttaagaaaccctaaaagtacggaaaactagtaagttagaagtacgtacgtagggaacggtaccgtaacggtcttcggttacggtttactttcgtaggttaacgaccggaaaacgttcgtaggtacggtaagggtagggggtttaaacggg

SEQ ID NO: 329438 - DNA, 564 bp, Homo sapiens
  misc_feature: GZ8MTXP02JD4N8.51.76.G10.1.454.CMB.2.raw
  modified_base (276)..(276): a, c, t, g, unknown or other
  misc_feature (276)..(276): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (525)..(525): a, c, t, g, unknown or other
  misc_feature (525)..(525): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattccaccttcagtcncctatggcatgcacgtgggtccgccgaggcctccgaggcgaaggggctgggaggtggggnggctatttanactcagatgatggactagtaaataaagagtangacgtagtccgtaccgtaggaacggggcctacgttccaacctatcctacaagacaactaacttacccaagaaaccactactagtactcgtagacaaatacgaaacagtatagagtacgacgtaggaacggacgacggtcttacggtnttattcgtagtcggaacgaaacgtctaggtaggtaaggg

SEQ ID NO: 329439 - DNA, 587 bp, Homo sapiens
  misc_feature: GZ8MTXP02GO6AS.51.76.G10.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctctgtgcngcctntgattcaccttcagtgcctanggcatcgcacgtgggtcccnccagggcctccgaggcgaaggggtctggggaggtggggtcggctaatttatatcaagagtgaatgggactaaaggtaaataaggattaatgactagttccgtccgggtaggaacggggccgtacttacacctatctacagacgtaactaacttacccaagaaacacactagtactctagacaaagtagaacagtagtggagagcgtaggacggacgacggtcttaggtagttacttcgtacggtaagtaacggtaaacgtacgtaagtggtaacgggtagggttaaagggg

SEQ ID NO: 329440 - DNA, 536 bp, Homo sapiens
  misc_feature: GZ8MTXP02FZFB6.51.76.G10.1.454.CMB.2.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (511)..(511): a, c, t, g, unknown or other
  misc_feature (511)..(511): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactcctccctcgcccgtcacccctggagacgccggcctccatcctcctgcaggtctagtcagacgcctctgcatagtatgatacatattgatgcactgcagancgaggcagtcncancgtctgactctatttgagttcctacggtccccgggtcccccgggtctgacgtacggttcgagtgctaggtgatcgaggcactagttattttacacgtaagaaatcgagacgagagtggagcgtaggtaggtagtttggtttagggttactcgtaattcgagtatacgacaacgtctaacctaacgtaaaacctcgtacgtacgtacgttcggacggtaacgacgtaaggngacgagtacgagacgtacgtgtacg

SEQ ID NO: 329441 - DNA, 691 bp, Homo sapiens
  misc_feature: GZ8MTXP02G0MGS.51.76.G10.1.454.CMB.2.raw
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccgagcccgggagtccctgagactctcctgtgcagcctctggattccaccttcagtcgcctagtggcatgcacgtcgggtccgccaggcctccgaggcgaaggggcctggaggtggggtacggctaagtttatacgtacgagtagtgagtggactaaggttaaaataaaaggtagttaagtcggtactacggttacccgttacccgggtaggaaaccgggggtcccgtaacttacccgaacccgtacttccccgtaaccgtaagaaaccggtaaccctaaaccttacccccgaaacgaaacctaaccttaacgtacgttacgtaccttaggaaccctaaaagttacgaaactagtaagtttaggaaccggtaagccggttaaggaacgggaaccgtacggtaccgtttagttaccgtttagtttaacccgtggttaaccgacggtaaaaccgtcgtaaggttaggttaaggggg

SEQ ID NO: 329442 - DNA, 610 bp, Homo sapiens
  misc_feature: GZ8MTXP02IOHY3.51.76.G10.1.454.CMB.2.raw
  modified_base (246)..(246): a, c, t, g, unknown or other
  misc_feature (246)..(246): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtcccctgagactctcctgtncagccctctggattccaccctttcagtcgcctatggcatcgccacgtcggggtccccgccagggcctcccgaggccgaaggggctgggaggttggggtggctagtttanatcagatgatgggacaagttaaataagngttaatgctagttctaccgggttaggaaacggggccagttccacccatccctacagaacgaactaacgtacccaagaaaccactacgtntactctagaacaaatacgaaanagtaagttcgaagacgacgtaggaacggtaccgtacgtcggttcgttagtttacgttttgtaggtaacgtaacggtaaaccgtcgttaagtggtaagggttagggtttaaaggggg

SEQ ID NO: 329443 - DNA, 598 bp, Homo sapiens
  misc_feature: GZ8MTXP02FYDE8.51.76.G10.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctctggattccaccttcagtcgcctagtggcatgctacgtcgggtccccnccagggcctccgagggcgaaggggctgggaggtggggtgctatttanatcagatgatggacaagtaatagngtangctagtctcgagacggccatcacntccacagacgaactaactacccaagaaccactactagtactcgtagaccaaagtacgaaacgagtaagtaggaagtagacgtaggaacgggtaaccgaccgggtcgttacggttagtttaacgtttcgtaggttaacggaaacgtaaaaccggtacgttaaggtaggggtaaggggttagggggtttaaaaggggg

SEQ ID NO: 329444 - DNA, 551 bp, Homo sapiens
  misc_feature: GZ8MTXP02HOEBO.51.76.G10.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgtacttagcctggtaccagcaagaacctggccaggcctccaggcctcctnatctatgatgcatccagaaggccatgatacncccagccaggttcagtgcaggtcgggntggggactaggtacgttccacttcaccacatcgagcacgctgcagtctagaagtctttagactttaatttattacttgtacagtactagtaataataacgtcgtaccttaccgtacttacgtttcggaccggttacggggacctaaggcgtagggactaactaaacgaaacggtaacgttaggtcggtacgtcgtaccgtaactacg

SEQ ID NO: 329445 - DNA, 579 bp, Homo sapiens
  misc_feature: GZ8MTXP02GW4UB.51.76.G10.1.454.CMB.2.raw
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccccgggagtccctgagactctcctgtgcagccctgtggattccaccttcagtcgcctagtggcatcgccacgtcgggtcccnccgaggcctaccgaggacgaaggggctggggagtggggtgtctagtttanactcgagagtgagtggaactagtaaanaaagngtancgactacgtccgtacgagaacggctactaccactactccacaagacaactactaccaacgtaacactacgtagtactacagaactaagtacgaaacagtagtagagacgtacgtaggaacggtacgtacggtcgttacggttactttacgttcgtacggtacgacgtaacgtacgtaggtaggtaggg

SEQ ID NO: 329446 - DNA, 648 bp, Homo sapiens
  misc_feature: GZ8MTXP02HMM7M.51.76.G10.1.454.CMB.2.raw
  modified_base (257)..(257): a, c, t, g, unknown or other
  misc_feature (257)..(257): n is a, c, g, or t
  modified_base (349)..(349): a, c, t, g, unknown or other
  misc_feature (349)..(349): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggagtccctgagactctcctgtgcagcctntggattccaccttcagtgcctagtggcatcgcacgtcgggtcccgcaggcctaccgaggacgaaggggctgggaggtgggtgactagtttanacgtcgaagatgatggaactaagttaaataaagacgttagtaggactagttacccgtaccgtaggaaaccgggtcctaatttacccaaccctacttaccctaccgaaagaaccgtaaactaaccgttaccccaaacgtaaacctaccgtaactagttaactacctagaaacctaaaagacgaaacgtaggtaattaggaaagacggtcgtaaaggaacggtaccgacggttcgttaacgttgtttaacttttcggaggtaacgaacccggtaaaacgtcgttaaggttagggtaagggg

SEQ ID NO: 329447 - DNA, 608 bp, Homo sapiens
  misc_feature: GZ8MTXP02JXAWQ.51.76.G10.1.454.CMB.2.raw
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccgaggcccgggaggtccctgagactctcctgtgcagcctcgtggacttcaccttcagtcgcctagtggcatgcacgtcgggtccgccgaggctaccgaggcgaacggggctgggaggtgggtgtcagttttaanacgtgagtatgagtacggataagtaaagtaaagtgtacgngtacgtacggtcgtacggtacggaacggacgtactaccacctactaccacgtaacgacaacctaacctaccgaacgaaaccacgtacgtagtactacgtacgaactaacgtaacgaatagtagtacgagtacgacgtaggacggtacgtacggtacgttcgttacgttacgttaacgtacggtacgtaacgtaacgtacgtaggtagggtacgggg

SEQ ID NO: 329448 - DNA, 713 bp, Homo sapiens
  misc_feature: GZ8MTXP02GJERA.51.76.G10.1.454.CMB.2.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcccggtacagacaacgaaacctggccaggcctcccgaggcctaccctcatcctatgatgaccactacccaacgaacgggccctaactcgaacttaccgtaccccagtacccgtaggttacccgaggtcggacgtagggtcggggtcgtaggggacctagtacggtttccaccgttcctacgaccctatacgacgtacgacggccttcggaacttacggttaccgtagttaaaaggttttctttacgtaacttttaaaagtttttacttaacgttacgtacgtagttaacgttaaagttaaaactttaaacgtaacggtttaccggttacccgtttaccgtttaacgttacgggtttaaccgggaaccggtaaaccggggtaaactaaacggttacggtagggaacttaaacggaaccggtaaaacgtaacggttaggtacggtaccgtaggaccctacgttacgttccg

SEQ ID NO: 329449 - DNA, 707 bp, Homo sapiens
  misc_feature: GZ8MTXP02IWKGH.51.76.G10.1.454.CMB.2.raw
  modified_base (668)..(668): a, c, t, g, unknown or other
  misc_feature (668)..(668): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtctccactctccctgcccgtcaccccgtggagacgccggcctccatcctcctgcaggtctagtcagacgcctctgctatagtagttggatacaacttagttggattggctaccgtgacaagaagccgaggggcaggtcctacccacgacggtcctgacttcttagtttgacgtttcctaacggtccccggggccccccgggttcctcgacggtacggttccgaggtcgggcctagggtgtaactcgacgggactaacgtagttatttaatacgtaagtaaaacttccgaagacgaaggtaggtacggggtacggtacgtagggtaagggttaggttgggggtttttacgggggttaattcgtaaggttacgtaccgtagttaccggacttaaccggtacctttaacgtaaaaccctaaaccgtttacccgtaggtttaaaccggttacccggtttacggggaaccggggtaaaccggggtaaccgtaaaagggggtaacgggttaaanaacggttacgaaacggtaacccggtagttacgggtacgg

SEQ ID NO: 329450 - DNA, 601 bp, Homo sapiens
  misc_feature: GZ8MTXP02FRVBA.51.76.G10.1.454.CMB.2.raw
  modified_base (188)..(188): a, c, t, g, unknown or other
  misc_feature (188)..(188): n is a, c, g, or t
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggaggtccctgagactctcctgtgcagcctcgtggattccaccttcagttcgcctatcggcatcgctacgtggggtcccncaggcctccgaggcgaaggggctggggacggtggggtgactatttanactcagatgatggacagtaataaagntactgactagtctcgtagaacggccattcaacgtactcctacaagacgaactaacttaccccgaaagaaaccactacgttatactacgtacgaactaaagtacgaaaacgtagtaagttagaacggtacgacgttaggaaccggaacgaaccgggttcgttacggttagtttacgtttcgtacggtaacgaacggtaacgtacgttacggtagggtaagggg

SEQ ID NO: 329451 - DNA, 580 bp, Homo sapiens
  misc_feature: GZ8MTXP02I99T6.51.76.G10.1.454.CMB.2.raw
  modified_base (445)..(445): a, c, t, g, unknown or other
  misc_feature (445)..(445): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactcctccctcgcccgtcaccctggagcgccgcctcatcctcctgcagtctagtcagcgcctctgcatagtatgatacattattgattgcactgcagacgccgaggcagtctccacgaggtcctgtattcttattcgtacgttcgtaacgtcccccggggtcccccggtctgacgtggttcgagtggctaggtcggactcgaggacacgtagttaatttaacgactaagaaactcgagacgtaaggagtgggagtgtaggagtagttgggtttacggttaancgttaagttgctaagtgtaacgagtactactaaacctaaacgttccttaacgttacggtaccggtttacggacgggttaacggaaccgttaggggaaccgtaacgatacccggaagtacggtaacgtggtaacgg

SEQ ID NO: 329452 - DNA, 628 bp, Homo sapiens
  misc_feature: GZ8MTXP02IPXL1.51.76.G10.1.454.CMB.2.raw
  modified_base (257)..(257): a, c, t, g, unknown or other
  misc_feature (257)..(257): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccaggcccgggagtccctgagactctctgtgcagcctntggattccaccttcagtgcctatggcatgcacgtcggggcccgccgaggtcctccgagggccgaaggggctgggagtggggtgctatttatatcgagatgatggactaaggtaaataggagtatagactaggttcctaccggttaggaacgggggccgtaacttccgaactacttccgtacccagaacgaacctaaaccttacccaagaaacctactaacttacgtacttcctagaacctaaaagtacgaaacagtaagtgtaagacgtacgtaggaacgggacgacgggttcgttaggttagttactttcgttaggtaacgtaaccggtaaacgtacgtagttacgggttagggtaggggtttaaagggg

SEQ ID NO: 329453 - DNA, 538 bp, Homo sapiens
  misc_feature: GZ8MTXP02G31JK.51.76.G10.1.454.CMB.2.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (442)..(442): a, c, t, g, unknown or other
  misc_feature (442)..(442): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtatggatacaactattggattggcacctgcagaagccagggcagtctccanaggtcctgatctatttgagttctaatccccggggcccccgggtcctgacnggttcagtggcagtggatcgaggcacgagtattttatactagaaaatcgaagtcaagagtgggaggctaggaggtagtcgggtttggggtttatcgtaagttganagtgactagctactaactaaactcctactagtaccgttacgggacggtaacgggaccgaaggtggagtaacgtacgaagaccgtaaacgtgtacgg

SEQ ID NO: 329454 - DNA, 544 bp, Homo sapiens
  misc_feature: GZ8MTXP02F6FPF.51.76.G10.1.454.CMB.2.raw
  modified_base (197)..(197): a, c, t, g, unknown or other
  misc_feature (197)..(197): n is a, c, g, or t
  modified_base (407)..(407): a, c, t, g, unknown or other
  misc_feature (407)..(407): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaaacctggccagggcctcccaggcctcctcatctatgatgcatccaacgaacggccactgactactccagcacggttcagtggctaggtggtcgtggggacaggtacgttcactctccacatcagcacgtctgcagtcgtagtaagttntttagtacttaatttacttactgtcagtctaagtaataataacgtcgtaccttacgtactacgtttcggacgacgggacctaagcgtaggacgtaactaacgaaacgtacgtacggtacggtctacggctacctacg

SEQ ID NO: 329455 - DNA, 531 bp, Homo sapiens
  misc_feature: GZ8MTXP02I2E0V.51.76.G10.1.454.CMB.2.raw
  modified_base (270)..(270): a, c, t, g, unknown or other
  misc_feature (270)..(270): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (439)..(439): a, c, t, g, unknown or other
  misc_feature (439)..(439): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgccaggtctagtcagacgcctctgcatagtattggatacatattgattgcacctgcagaancagggcagtctccagaggtcctgattctattgagttctaacgtccccggggcccccgggtctgacgtaggttcaggtggcagtggatcgaaggcaactagtattttanaactagaaactnagactagagtggagctaggnggtagttgggttagggttatcgttatcgnagtgacaacgtctacaactaaaccgtctacttacgccgttacggacgggacggacgaagggtggaacgtactacgaagcgtaacgtggtacg

SEQ ID NO: 329456 - DNA, 697 bp, Homo sapiens
  misc_feature: GZ8MTXP02IP6M7.51.76.G10.1.454.CMB.2.raw
  modified_base (510)..(510): a, c, t, g, unknown or other
  misc_feature (510)..(510): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtgggatattgtgatgactcagtctccactctccctgccccgtcacccctggagacgccggcctccatcctcctgcaggtctagtcagacgcctcctgctagtagttagttggaactaactaacttagtttggattggaccaccgtgaccaaggaacgccgaggggtcacgtcctacccgacgtacgggtcccttaggtactttacttagtttcggtacgtttacgtaaccggttcccccccgggggcccccccggggttcctacggtaccgtacggtttccaggttcgggacctaggtcggactacggacggactacgtaagtttaatttacgtaactaaagaaaactcgaagcgaaggtggtaagggacgtntagggtagtgttacgggtttggttactagtagttcgattagcgaacgtagttactacctaaaccttaaaacctccgttaacgttaacggttacccggttacgggaacggggtaaacccggtaaacgtacggggttaaacgggataaacgttaccggaaaacggtacccgttaaacggttggtaccgg

SEQ ID NO: 329457 - DNA, 725 bp, Homo sapiens
  misc_feature: GZ8MTXP02HGNRH.51.76.G10.1.454.CMB.2.raw
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagccctntggacttcgacccttcgagtgcctatcggcagtgaccacgtggggtccccncgaggcctacgagggacgaaggggtcgtagggaggtggggtcgacttaatttanacgtcaagtagtacgagtggtaacaaaggttaaaataaaggtgttaactcggactaacggttccgtaccgggtaagggaaacggggtcccgtaaacttacccaaccctacgttaccctaccgaaaggtaaccgtaaaacccgttaaaccttaaccccgaaaggtaaaaccctacgtaaccgtttagttaactaccgtaacgaaactaaaacgtacggaaaacgtagtaacgttaggaacggtaacgtacgttaacgggaacggaaccgtaacggtcgtttaggtttacgtttacgttttacggaggtaacggtaaacgtaaaacggtacgttaaagtaacgggaaacggtttgggggtaaaaggg

SEQ ID NO: 329458 - DNA, 639 bp, Homo sapiens
  misc_feature: GZ8MTXP02GZFU8.51.76.G10.1.454.CMB.2.raw
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctcgtggtattccacctttcagttcgcctagtcggcatcgcacgtcggggtccccncagggtccctccgaggccgaaggggctgggagtggggtgctaatttagatcagtntgatggacaagtaaataggagtatcgctagtctcgggtaggaaacggggtcctaattccaacctatcccgtaccaacgaacgtaacctaaacttcccgaaagaaacctaccgtaacttaggtaactacctagaacctaaaagtagaaacgtagtaagttggaagacgcgtaagggacggaacgtaccgggttagttacggttacgttacgttacggtaagtaacggtaacgtaaacgtacgttaggtacgggtaacggggttacggggttaaaggg

SEQ ID NO: 329459 - DNA, 638 bp, Homo sapiens
  misc_feature: GZ8MTXP02HIKCO.51.76.G10.1.454.CMB.2.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgagactctcctgtgcagcctcgtggacttcaccttgagtgacctagtcggcagtcgctacgtcgggtcccnccgaggccctaccgaggacgaaggggtctggggaggttggggtgacttaagttttaanacgtgagtagtagagtaggaactaaagtaaaagtaaggtacgttagtcgacgtacgttccgtacgggtaagggaacggtaccgtacttaccgaacgtactacccgtacgaacgaactaacctaaccgtaccgaactaaaccacgtacgtacgtactacgtactaaacgtaagaacgaagtagtagtagagtacgcgacggacgacgtacgtcgttagttacgttacgtgtacgtaacgtaacgtacgtagtaggtaggtagggttaaggtaggg

SEQ ID NO: 329460 - DNA, 668 bp, Homo sapiens
  misc_feature: GZ8MTXP02IMQQK.51.76.G10.1.454.CMB.2.raw
  modified_base (385)..(385): a, c, t, g, unknown or other
  misc_feature (385)..(385): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggaggcggtggtccgaggcccggggagtccctgacgctctcctgtcgcacgcctgtggacttccaccttcgagtcgcctagtggcagtgcctacggtcgggtccccgccgacggtcctacccggagggccggaagggggtctggggacggttggggtcgtacttaagttttacncgtacgagtagtgtagttacggaactaggttaaaataaaggtattagtcgtactacggttcccgtacggtaggaacggtcctaacttcaccctattcccgtaacgacgtaacgaacctaaccgttacccgaaacgtaaccaacttgtacgttactacccgtaagaaactaaagtaacgaagtaagtagtaagaacgtagtacgacgggtaacgtaaccgcggttacgttacgttagtttacgttcggtagacgtaaccgtagtacgtagttaggggtaagggg

SEQ ID NO: 329461 - DNA, 584 bp, Homo sapiens
  misc_feature: GZ8MTXP02ICP9D.51.76.G10.1.454.CMB.2.raw
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtcgcctatggcatgcactggggtccccncgagcncgaggcgaggggctggaggtgggtgactatttanatgagtatgagtggataagtaaagtagagtatcgacgtacgtccgtacggtaggaacgggtccgtacttccgacctactcctacgaagacgaactaaccgtaccaacgaaaccactacgtagttatcgtagaacaaagtacgaacgtagtagtagacgacgacgtaggacggacgtacggtcgttagttacgttacgtttcgacggtaacgaacgtaaacgtctaggtaggtagggttagggtaggg

SEQ ID NO: 329462 - DNA, 557 bp, Homo sapiens
  misc_feature: GZ8MTXP02IPGKG.51.76.G10.1.454.CMB.2.raw
  modified_base (257)..(257): a, c, t, g, unknown or other
  misc_feature (257)..(257): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctntggattccaccttcagtgcctatggcatgcacgtgggtcccgccgaggcctccgaggcgaaggggctgggaggtggggtgctagtttatactcagtatgagtggacagtaaanaaagngtatgnagtcgcgtagacggcatcaccatctacagacgacaacgttacccaagaaaccactacgtagtacttacctagaaacctaaaatacggaaactagtagtagaacgagtacgtaggacgaacggacggtcttacgttagttattcgtgtacgacgtaacgtctaagtggtaaacgggg

SEQ ID NO: 329463 - DNA, 651 bp, Homo sapiens
  misc_feature: GZ8MTXP02HOAFZ.51.76.G10.1.454.CMB.2.raw
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (386)..(386): a, c, t, g, unknown or other
  misc_feature (386)..(386): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcgagggccagtcaggagtgttagcagcgtacttagcctggtaccagcaagaaacctgggtcaggcctcccatcgctcctnatctangatgcatccgaacgagggtcccagtgatactccccgagccccgtagttcaggtggctaggttcggggtctggggacaggtacgttcncgtctaccaccgtatccacgccgacgtcccgttcggacctaggttccgttaggtaaaggttacttttacggaaccttttaatttttaacgtttaaccgttgttacgtaacgtactaaagttaaataaacgttaacgtacggtacccgttaccgttacgtttaccgtttacgggaccggtaaacggggtacctaaacggtacgtaggtaaacgaacgttaaccgaaaacggtaaccgtggtacggtaccgacgttacccgtaaccg

SEQ ID NO: 329464 - DNA, 659 bp, Homo sapiens
  misc_feature: GZ8MTXP02H363G.51.76.G10.1.454.CMB.2.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgggagtccctgagactctcctgtgcagcctctggattcacccttnagtcgcctagtggcatgcacgtcggggtccnccgaggcctccgaggccgaaggggctgggagtggggtgctagttttanatnagntagagtacggataaagtaaataggtntancgactagtcgtacgtaggaacggtcctatcccaactacnccgtacgaagaactaaacctaacctacccgaaagtaaaccctacgttaacgttagttaactacgtaacgtaaactaaaagtaaacgtaaacgtaagtaagtaaggtaacggaacggtaacggtaacggtaacggtaaccggtaccggtacggttacggttacgtttacgtttacgttacggtaacggtaacggtaaacggtacgtaaggttagggtaaggggttaaggggttaagggg

SEQ ID NO: 329465 - DNA, 716 bp, Homo sapiens
  misc_feature: GZ8MTXP02I3WL5.51.76.G10.1.454.CMB.2.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (265)..(265): a, c, t, g, unknown or other
  misc_feature (265)..(265): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgctcttttaagaggtgtccagtgtcaggtncagctggtggagtcggtggggggacgtcggtcggtaccgaccgggccgggtacgtccgtagacgtctcctcgtgtcncgcgtcctgtagtctacctcctgagtcactagcgactagtcgaccgtacgggttccggcccacggcggccctaccggacggacgggacggggtcgtaggggtacgggttgggtacgtattaattttacgacgtacgagtagtagagtcgaataagtaaagtaaagtagttacgcgtacgtacgtccgtacgggaaggtaccggtacctaacttacccaaaccgtctacccgtaacgaacggtaaacctaaaccttaccgttaaaccggaaacctaaaccaaccgttacgttacttaccgtaaccgtaacggaaactaaaggttaacgaacgtaagttagtaaacggaagtacggtacggtaggaaaccggacgtacggttacgttacgttagtttaacccgttggacgggttaaccgaacggtaatacggttaaggtagggttaaaggggg

SEQ ID NO: 329466 - DNA, 753 bp, Homo sapiens
  misc_feature: GZ8MTXP02GG73B.51.76.G10.1.454.CMB.2.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (394)..(394): a, c, t, g, unknown or other
  misc_feature (394)..(394): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttggctgagctgggttttcctcgttgcttcttttaagaggtgtccagtgtcaggtgcagctggtggagtcggtgggggaggcgtcggtccaggccccggggaggtccctgacgactctcctgtgcagcctntggtacttctaccttnagtcgcctagtcggcagtcgctacggtcgggtcccgccgagggtccctaccggagggtccggaaaggggtcgtaggggagggttggggtggtacttaagtttagtacttacgaagtntagagtcgggaactaaaggtaaaataaggtagtagtacggaccgtacgttaccgttccgggaagggtaaaccggggtccttaaacgttacccgaacctacgttacccgtaaccgaacggtaaaccgtaaacccttaaaccgttacccccgaaagtaaaccctaacctaacgtttacgttacctccgttaaaagaaaacctaaaacgttaaacgaacgtaagttaacgtaggaaagtacggaccggttaagggaaccggttaacggaccggtttgttacggtttaatttaccgttaccggtagtaaccggaaacgtaaccgtagttaggtaggggtacggttagggggtttaaaaggggg

SEQ ID NO: 329467 - DNA, 703 bp, Homo sapiens
  misc_feature: GZ8MTXP02HEHXX.51.76.G10.1.454.CMB.2.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgacgactctcctgtgcagcctctggacttcaccttcagtgcctatggcatcgcacgtcgggtcccnccgaggcctccgaggcgaaggggctgggagtggggtgctattttanactcgagtatgagtgacagtaaataaaggagtactggactaggttccgtacccggtaggaaacgggtccgtaacgttacccaacccgtacttcccgtacccgaaaggtaaccgtaaaacctaaaccgtttacccccgaaaagaaaacccctaaccctaaccgttaggttaaccttaccgttaacggaaacccttaaaagtacgtaaaaccgaaggttaacgttaagggaacgtaacggtaccgttagggaaacggtaaaccgtaccgggtacgttagggtttaacgtttacgttttccggtaggttaaccggtaaaccggaaaaccgttacgttaacggtaggggtttaaaggggg

SEQ ID NO: 329468 - DNA, 615 bp, Homo sapiens
  misc_feature: GZ8MTXP02JXISA.51.76.G10.1.454.CMB.2.raw
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcccgggagtccctgacgactctcctgtgcagcctctggattcaccttcagtgcctatggcatgccacgtcggtccgccgaggcctccgaggcgaaggggctgggagtgggtgctatttanatcagactgatggacagtaaataaagngtatgacgtagtccgtcgtaggaacgggtccgtattaccgacctatcccgtaccgaacgaacgacctaaacttaccccgaaagaaaccctactacgtagtacgtcctacgaactaaacgacgtaaacgaagtagttaggaagtacgtaccggtaaggaacggaaccgtacggtacgttaggttacgtttacgtttcgtacggttaacgaccggtaaaacgtccggttaagtaggggttaaggggg

SEQ ID NO: 329469 - DNA, 584 bp, Homo sapiens
  misc_feature: GZ8MTXP02J22BK.51.76.G10.1.454.CMB.2.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccagtcagagtgttagcagcgtacttagcctaggtaccagcaagaacctggccaggcctcccgaggcctcctnatctatgatcgctactccaagacggccatgatactcccagtccgtaggttcaggtcggcgtaggtcgggtctggggactaggtnttcacgttctacaccatacgacgcacgtcctgcgtagtcgtagtaacgttatttacgtacttaatttacttacgtgtactacggtactaagtattaaacgtacgtcgtacccttacgtacgttacgtttacggaccggtacgggaccgaagtccggtagaacgtaactaaccggaaacgtaaccgtggtacggtactcggacctacgttacg

SEQ ID NO: 329470 - DNA, 659 bp, Homo sapiens
  misc_feature: GZ8MTXP02H2SN7.51.76.G10.1.454.CMB.2.raw
  modified_base (188)..(188): a, c, t, g, unknown or other
  misc_feature (188)..(188): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctgggtgagtcgtgggggagcgtggtccaggcccggggagtccctgacgctctcgngtgcagcctcgtggacttcacttcagtgcctagtggctatgccacgtcgggtccnccgaggctaccgagggcgaaacggggntgggagtggggtgctaattagtagtcgaagtagtggacgtggactaagtaaattaaaaggngtagacgacgtacgtaccgtacggtaggaccggtaccgtactacccgaaccgtactaccgtaacgaaacgtaaccgtaaccgtaaaccgtacccgaaagaaaccctacgttaaactcgtaacgtacgtaagaaaacctaaaggtaacgaacaaacgtaacgtaacggaacggtacggtacggtaggaacggtacggtacggtacgtacgttacgtttacgttaacgttacggtaacggtaacgtaacgtacgtaacggttacggtaggg

SEQ ID NO: 329471 - DNA, 812 bp, Homo sapiens
  misc_feature: GZ8MTXP02HCNUR.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccaggtggggatattgtgatgactcagtctccactcctccctcgcccgtcaccccgtggacgacgccggcctccactcctcctgctaggtctagtcagcgcctcctgctagtagtagtgaatacacttagttggattcggcacctgacagaacgcgagggctacgtccaccacgtaccggtctagtacttacgtttagttcggttaacgttccggttaaccgggtcccccccccggggggtaccccccgggttccgtacggaaccggttacgggtttcgacgggttcgggacgttagggtacgggactacgacgggactaacggttaagtttactttaaactaacgtaaaggtaaaactccggtaacggacggtaagggtacgggttaggggaggtcgggtaaaggggttagggtttaacgggtttggggtttttaagggggttaccttacgggttaaggtttccgacgtaaggtttccgggaaacttaaacccgggttacctttaaaaccgtaaaacccggttaaaacctttcccggtttaaaccgggtttaaaccggttacccgggggttaaaccgggggaccgggggtaaaaccgggtaccgggttaaagggggaagttaaaacggaaccgttaacgggaaaacgtcccgggtttaaacgggtcggttaaccgggg

SEQ ID NO: 329472 - DNA, 522 bp, Homo sapiens
  misc_feature: GZ8MTXP02FJRLQ.51.76.G10.1.454.CMB.2.raw
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcacgtgggtccnccaggcctccaggcgaaggggctggagtggggtggctagtttatatcaagatgatggacaagtaataagngtatgcagtctcgagaacggcgatcacntcncaganacatcccagaaacacactgtatctagacaaatgaacagtatgagtagctaggagacacggtcgtagttgttactttcgtagtaacgacggtaaaacgtctaagtaggtaggtaggggtaaggg

SEQ ID NO: 329473 - DNA, 731 bp, Homo sapiens
  misc_feature: GZ8MTXP02FVA8Y.51.76.G10.1.454.CMB.2.raw
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagtctgggttttcctcgttgcttcttttaagaggtgtccagtgtcaggtgcagcgtggtggagtcgtgggggagcgtggtccaggcccgggaggtccctgacgactctccgtgtcgcagtccctgtgtacttccaccttcagtcncctagtcggcagtcgctacggttcgggccccnccgaggccctaccgagggacgaaggggtctgggaggtggggtagtactaagtttanagtcgagtagtagacgttggaataaaggttaaaactaaggagttacgtaggacctacggttaccgttaccgggaagggaacggggtacccttaacttacccaaaccctagttacccgaaccgaacggaacctaaaccgtaaaccttaaccccggaactaaaacccgactaccttagttactaccttaacggaaacttaaaacggaagtaacgaaagtttagaggtaagaccggacgtaagggacgtaaccggtaccgggttagttaggtttacgtttaacgtttcggtaacgggtaacggtaaaaccgtaaacggttacgttaaggttagggggtagggtttacgggggtttaaaggggg

SEQ ID NO: 329474 - DNA, 620 bp, Homo sapiens
  misc_feature: GZ8MTXP02JHOFX.51.76.G10.1.454.CMB.2.raw
  modified_base (301)..(301): a, c, t, g, unknown or other
  misc_feature (301)..(301): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggcccgggaggtccctgacgctctcctgtgcagcctctggattccaccttcagtcgcctatggcatgcacgtcgggtcccncaggcctcgaggcgaaggggctgggaggtgggtgctatttatatcagatgatggactaaagtaataagtagtactgctagtcgtaccggaggtaaccgggcctacgttacccacctacttcctaccgagaacgtaacctaacttaccccaagaaaccactacttagtactactacgaacaaagtacgaaacagtaattggaagacgtacgtacgggaacggaccggtacgggtcgttcggtttagtttactttcgtaggttaaccggaacgttaaaaccgtcgttaaggtaggggtacggttagggggtttaaaggggg

SEQ ID NO: 329475 - DNA, 530 bp, Homo sapiens
  misc_feature: GZ8MTXP02I9031.51.76.G10.1.454.CMB.2.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (478)..(478): a, c, t, g, unknown or other
  misc_feature (478)..(478): n is a, c, g, or t
  modified_base (512)..(512): a, c, t, g, unknown or other
  misc_feature (512)..(512): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcacgtgggtcccgccagggctccaggcaggggctggagtgggnggctagtttanatcagtatgatggacaaggtaaataaggngtatgacaggttctccggtaggaacgggccgtattcgacctatcctacagagacaacttcccaagaaccactactagtatctagacaaatgaacagattgagagctagaggacncggtcttagtgttacttctggtcgacgaaacgtnagtgaggtagggtaaggg

SEQ ID NO: 329476 - DNA, 584 bp, Homo sapiens
  misc_feature: GZ8MTXP02G2LFL.51.76.G10.1.454.CMB.2.raw
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggagcgtggtccaggcccgggagtccctgacgactctcctgtgcacgtcctcgtggacttccaccttnagtcgcctagtgcatgcncgtcgggtccncgaggcctcgaggcgaggggctgggaggttgggngtctaagtttanactagagtagtggagtacggaagtaagtaaaataaaggtagtagtagacgtacgtccgtacggtacggaacggccgtactaccactactccacgaagacactaactaccaacgaacactagtntactacacgaacaagtacgaacagtagtagagtacgagtaggacgtacgacgtacgttagttcgttacgttcgtacggacgtaacgtacgtagttaggtaggtaggg

SEQ ID NO: 329477 - DNA, 546 bp, Homo sapiens
  misc_feature: GZ8MTXP02JFL68.51.76.G10.1.454.CMB.2.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccggagcccgggagtccctgagactctcctgtgcagcctctggattcacttcagtcgcctanggcatgcacgtcgggtccnccaggcctaccgaggccgaaggggctgggagtgggtgactatttaanatgagatgatggataagtaaagtagngtangactagtcgtcggaggaacggctactacacatccacgagaacaactactaccaagaaacactactagtactactagaacaaanaagaacgaagagtagagagagacgagacgacgtacgtagtagttacgttagtagtaagacgtaacgtacgtagtaggtaggtaggtagg

SEQ ID NO: 329478 - DNA, 590 bp, Homo sapiens
  misc_feature: GZ8MTXP02FQNQB.51.76.G10.1.454.CMB.2.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtcccncctaggcctccgaggcgaaggggctgggaggtgggtgctatttanactcgagatgatggactagtaaanaaaaggtgtatgactagttccctccgtaggaaacgggccattaccgaccactcctacaaggacaacctacttacccgaagaaaccacgtactagtactacgtacgactaaaagtaggaaactagtaacgttagaagtaacgcgtaggaaccggaacgtacggggtcttacggttagttaactttcgtaggtacgaccggtaaacgtcgtaagtggtaaaggggg

SEQ ID NO: 329479 - DNA, 681 bp, Homo sapiens
  misc_feature: GZ8MTXP02I78ZR.51.76.G10.1.454.CMB.2.raw
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccacggcccgggagtccctgacgactctcctgtgcagcctgtggacttccaccttcagtcgcctagtggcatcgctacgtcgggtcccgccgacggcctaccgaggcggaaggggctagggaggtggggtgctagtttacatcagtatgtagtcggactaagttaaagtaaggtgttagcggtaccgtacgtccgttacggtaacggggaacgggtcgtaaccttaccgaaccctacttcccgtaaccgaagtaacgaaacccttaaccgttaccccgaaacaaaacccacttaaccgttacgttaccttacttaacgaactaaagtaacgaacgtaagtaagttagacgacgtacgtacgggacggtaccgtacggtcgtttaggttacgtttaacgtttccgtagtaaccggtaaacgtaaaccgttacgtaaggtaggtacggggttaggggtttaaaggggg

SEQ ID NO: 329480 - DNA, 562 bp, Homo sapiens
  misc_feature: GZ8MTXP02FTYIA.51.76.G10.1.454.CMB.2.raw
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (514)..(514): a, c, t, g, unknown or other
  misc_feature (514)..(514): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtncctatggcatgcacgtgggtccnccgaggctccgaggcgaaggggctgggaggtgggtgctatttanactcagntggatggactagtaaataaagagtatgctagtctacgtgaacggcacgttcacgtactctacgaagacgaacctaacttaccccaaagaaaccactacgtagtactcgtagaactaaagtgaaactagtagtagaagacgcgtagacggtacgaacgtcgttagtntttacgttcgtagtacgtaaccgtaacgtcgtaagtgggttaaagggg

SEQ ID NO: 329481 - DNA, 577 bp, Homo sapiens
  misc_feature: GZ8MTXP02FX3XU.51.76.G10.1.454.CMB.2.raw
  modified_base (197)..(197): a, c, t, g, unknown or other
  misc_feature (197)..(197): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaanagcccaccctctcctgcgagggccagtcagagtgttagcagcgattagcctgtaccagcaagaacctggaccaggcctcccgaggtcctcctacatactatgatgactataccacgaacgggccatgactactacccagtaccgaccggttacgacgtggacgtagggttcgggtcgtggggacaggtacgttccactacgtccactactcgacgtcacgtctgcagtctagtaattacttagtaacttaatttattaccgtagtactacgtattataattaaacgtacgtcggtacctaccgttactacgtttcggacgacgggtaacaggtacgngaanacgtaacgaaggtaactggtacgacgtacgacacttacg

SEQ ID NO: 329482 - DNA, 532 bp, Homo sapiens
  misc_feature: GZ8MTXP02F27RF.51.76.G10.1.454.CMB.2.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctcgtggattccaccttcagtgcctatggcatgccacgtcgggtcccnccgaggcctccgaggcgaaggggctggagtggggtgctattanatcagatgatggnaagtaatagntangacagtcncgtagacggcgatcacatcacgagacgactaactacccaagaaccacgtactcgtatctagacaaatagaacagtatagagtagcgtaggacgacgacggtatgtacgttattcgtagtaacgacgaaacgtctagtggtaaggtgggttaagggg

SEQ ID NO: 329483 - DNA, 762 bp, Homo sapiens
  misc_feature: GZ8MTXP02IZRH2.51.76.G10.1.454.CMB.2.raw
  modified_base (152)..(152): a, c, t, g, unknown or other
  misc_feature (152)..(152): n is a, c, g, or t
  modified_base (187)..(187): a, c, t, g, unknown or other
  misc_feature (187)..(187): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (643)..(643): a, c, t, g, unknown or other
  misc_feature (643)..(643): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttccncgttgcttcttttaagaggtgtccagtgtcaggtncagctgggtggagtcgtgggggaggcgtggtccaggcccgggtaggtcccctgacgactctccgtgtcgcagcctctggattccacctttcagtgccctatcggcagtcgcacgtcggggtcccnccagggcctacccgtagggccggaaggggctaggggacgggttggggtgtacctaattttanacgttacagtatggagtcggggtactaaaggttaaaactaaagggtagtttaaggtcggtaaccgttaccgggttaccggttaccggggttaacgggaaaaccgggggtccctaaaccggtttacccaaacccggttacttcccgttaaccgaacggaaacgtaacccctaaaactttacccccgaagtaaaaccctaccttaaaccgtcggttaaacttccgtacggaaacctaaagtaacggaaactaaggtacgttaggtaaaggngtacgtaacggggaacgaacggtaaccggtcgttaggtttcttaaaccgttttgacggttaacggaaccccggtaaagttacggtagttacgggggacggttaagggggtttaaagggg

SEQ ID NO: 329484 - DNA, 531 bp, Homo sapiens
  misc_feature: GZ8MTXP02FFJ27.51.76.G10.1.454.CMB.2.raw
  modified_base (152)..(152): a, c, t, g, unknown or other
  misc_feature (152)..(152): n is a, c, g, or t
  modified_base (168)..(168): a, c, t, g, unknown or other
  misc_feature (168)..(168): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttccncgttgctcttttaagnggtgtccagtgtcaggtgcagctggtggagtcgtggggagcgtggtccaggcccgggagtccctgagactctcctgtgcagcctcgtggattcacttcagtgcctatggcatgcacgtggcccncaggcctccgaggcgaaggggctgggagtggggtgactagttatntacagtatgactggacaaggtaaataacgagtatgacagtctcgaggaacgggctatcgacatcgcaganactactacccagaacacatcgatctagacaatacgaatagatgaacgngacgagaacggactacggtcgtgtacgttattcgagtcgaaacgacgtacgtagttaggagggtgggtttaaaggg

SEQ ID NO: 329485 - DNA, 582 bp, Homo sapiens
  misc_feature: GZ8MTXP02GKQ9V.51.76.G10.1.454.CMB.2.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagtcttgggttttcctcgttgcttcttttaagnggtntccagtgtcaggtgcagctggtggagtcgtgggggagcgtggccagcccgggagtccctgacgactctcctgtgcacgcctcgtggtacttccaccttnagtgcctagtggcatcgcagtcggccncgaggcctcggaggcgaagggcgtggacggttgggtgactaattttacgatcgagtagtgacgtaggactagtaaanaaagtagtactgcacgtccgttacgaggaaaccggctacttaccaaccgtatccctacgaaacggtacaaactaaccttaacccaaagaaacctacctagtactacttacacgaacgtaaanaagaaagagtagtagagacgagagacgacgacgtcgtacgttagttagttgtcgtacgacgtaagtacgtagtaggtagg

SEQ ID NO: 329486 - DNA, 631 bp, Homo sapiens
  misc_feature: GZ8MTXP02JCIAH.51.76.G10.1.454.CMB.2.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtcgcagcctgtggattccaccttcagtcgcctatggcatgcctacgtcgggtcccncagggcctaccgagggccgaagggggctggggaggttggggtcgctaatttanatcgaggtatgatcgggataaggttaataaggngtaatgacagttccgtaccgggtagaaacggggccgtaattccacgatcctaccgagacgaactaacttacccgaagtaaacctactaacgttcgtaacttaccgtacgtaaactaaaacgttacgaaaacgtagtaagttgaagtacgagtaggacggtaccgacgggtcttaggttacgttactttcgtaggtaacgaccggtaaaacgtcgtaaggtggtaacgggtggggttaaaggg

SEQ ID NO: 329487 - DNA, 568 bp, Homo sapiens
  misc_feature: GZ8MTXP02JIGY1.51.76.G10.1.454.CMB.2.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtcccaggcccgggagtccctgacgactctcctgtgcagccctnggtacttccaccttcagtgcctagtggcagtgccacgtcggtccncgaggcctccggaggcgaggggctgggaggttgggngtactatttatagtcagatgagtgactaagtaaatagngttangctagtctaccgnggaacggctatccactatctacganacgactactaccganaacncacgtntatcgagacaaatnaacagtatagagtagcgtaggacggacgtaccggtgttagtttacgttatttccgtagttcggaacgtaaaacgtcgttagtacggtagggtagggtttaaacgggg

SEQ ID NO: 329488 - DNA, 575 bp, Homo sapiens
  misc_feature: GZ8MTXP02JYEUO.51.76.G10.1.454.CMB.2.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (466)..(466): a, c, t, g, unknown or other
  misc_feature (466)..(466): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggtgggggaggcgtggtccaggcccgggagtccctgacgctctcgtgtgcngcctgtggtacttccaccttcagtcgcctatggcatgcacgtggtccncgagctaccgaggcgaaggggtctgggagtggggtgactaatttnactacgagtgtagagtggataagtaaagaaacgtatagngactagtccgtacgtaggaacggctactccgaactntcctacgagataacgacctaccaagaacacgtatagtatcgtaanaaactaagagaaacgtagtagaggaacgagtagacggaacgacgtcggtacttacggttagtttacgtaacgtcgtaacgaaccgtacgtacgtagggtacggtagggg

SEQ ID NO: 329489 - DNA, 656 bp, Homo sapiens
  misc_feature: GZ8MTXP02GDC87.51.76.G10.1.454.CMB.2.raw
  modified_base (378)..(378): a, c, t, g, unknown or other
  misc_feature (378)..(378): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagctctcctgtgcagcctcgtggattcaccttcagttcgccttagtcggacagtcgccgtacgtcggggtaccccgccgaggcctacccgaggtaccggaaggggccgtaggggagggttggggtcggtacttaattttanaagttcgaaggtatagagtggactaaggttaaataaaaggagttagtgacgtaaggtccgttaccggtaggtaaacggccgtaacttaccaacctactcctacgagtaactacctaacgttacccaaggaaacactactagtactactacgaataaatacgtaaacagtaaagttagaaagacgtacgtaggaacggtaacgtcggtacttacggttcgtttaaagttccgtagggttaccgaaacggtaaacgtcttaaacggtgggttaaacgggg

SEQ ID NO: 329490 - DNA, 676 bp, Homo sapiens
  misc_feature: GZ8MTXP02FZVDK.51.76.G10.1.454.CMB.2.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggtgggggagcgtcgggtccaggcccgggaggtccctgagctctcctgtgcagcctcgtggacttcaccttcagtncctagtggcatgcctacgtggggccnccgaggcctccgaggcggaaggggctgggaggtgggtcgctatttanagtcagntgagtagataaagttaaataggatcgtgactagtccgtcgggtagaaccgggtctaactcgaactacttccgacaggtaacaaactaacctacccaaaagtaacccacgttaactacgttatacctaacggtaaactaaaagtacgtaaacgtaaagggttaagttaggaaagtaccgggttacaaacgggggtaacgggtaacccaccggggtttatttacgggtttacttttaacgtttccggtagggtaaaccgtaaaccggtaaacgttacggttaaaggtacggggttaagggggtacgggggtttaaaaggggg

SEQ ID NO: 329491 - DNA, 568 bp, Homo sapiens
  misc_feature: GZ8MTXP02FWIET.51.76.G10.1.454.CMB.2.raw
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggaggtccctgacgactctcctgtgcagcctctggacttcaccttnagtcgcctatggcatcgccacgtcgggtcccgcaggcctccgaggcgaaggggctgggaggttgggtgctaagttttanactcagtatgatggatagtaaanaagngtangactagtctcgtagaacgggctattccactatcacagacgactacttacccaagaaccacactagtaactcgtagaactaaagtagaaactagattaggaacgaagtcgtaggaaacggtacgaccggtcgttagtggtttaattcgtggaacgtaaccggaaagtctacggtaggttaagggg

SEQ ID NO: 329492 - DNA, 767 bp, Homo sapiens
  misc_feature: GZ8MTXP02FQKGW.51.76.G10.1.454.CMB.2.raw
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctctgcatagtattgatacatattggatggcactgcagaagccagggcagtctccacgaggtcctagattcgttatttgagtttccgtaaacggtccccccgggggtcccccccggggttcctaggtaccgtacggggtttccgagggttcggggacctaggggttggaacgttaccgaacggggtacctaaagtaagtttaaagtttttaaactaaacgttaaaggtaaaaaacttacccgaaggaccgtaaagggtaacgggttaggggaaacgggttccgttaaggggtaaacgggttaggttttacgggggtttagggggtttttaaatccggttaaagttttgggaccttaaggtacggtaaaccgaaggttacccttaaccttaaaacccgttaaaacctttacccccgttaggtttaaacggttaacccgggttttaccggggaaccgggggtaaaccgggtaaacccgtaaagggggttggaaaccggtaagttaaccgaacgggtaaccgtaaaccggtgggttaaccggg

SEQ ID NO: 329493 - DNA, 696 bp, Homo sapiens
  misc_feature: GZ8MTXP02GGIUP.51.76.G10.1.454.CMB.2.raw
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (675)..(675): a, c, t, g, unknown or other
  misc_feature (675)..(675): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagttgggctgagctgggttttcctcgttgcttcttttaagaggtgtccagtgtcaggtgcagctggtggagtcgtgggggagcgtggtccaggcccgggaggtccctgacgactctcctgtcgcagccctntaggcttcacccttnagtcncctagtggcagtcgacctacgtcgggtcccncccgaggccctaccggaggggaccggtaaaggggggtcctagggggagggttgggggtacgacctttaagttttaactacgtacgaaggtaataggaaggttcggaactaagggttaaaataaaggggtattaacgtcgacgtaacgggttcccgtacgggtaagggaaaccgggtccctaacttcccaaccttactcccgtaacgaaggaaccaaactaaaccgttaccccgaaagaaaccctactaaccgttagtacctacgtacaaactaaacgtacgaaacgtagtaagtagagtaaggcgtaaggacggaaaccgtacggttgttaacggtgtttacgtccgtaggacgtaaccggtanacgtttaggtacggtaagggg

SEQ ID NO: 329494 - DNA, 624 bp, Homo sapiens
  misc_feature: GZ8MTXP02JO1TV.51.76.G10.1.454.CMB.2.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctntggacttcaccttnagtcgcctatggcatcgctacgtcggggtccnccaggcctccgaggccgaaggggtctagggaggtggggtgtactatttanactnaagtntgatgacaagtaaataacggntangctagtcgtacgaggaacgtctatacactctccacagaactaacctaactacccaacgaaacacgtaatagttacacgtacgaaactaaacgtacgaaacgtagtaacgtaggaaacggtagtacggtaacgggaacggtaaccgaccgggttagttaggtttacgttacgtttccgtaagggtaacgtaaacggtaaaccggtagttaaggtaggggtacggggttaggggtaaagggg

SEQ ID NO: 329495 - DNA, 664 bp, Homo sapiens
  misc_feature: GZ8MTXP02IGJ5X.51.76.G10.1.454.CMB.2.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtcccctgacgactctccgtgtgcagcctcgtggacttcacccttnagtcgcctatcggcatcgctacgtcggggtccnccaggcctccgaggccgaagggggctagggacggtggggtcgacgtaatttatacgtcagtatggatgggactaaggttaaaataaggagttagtgaccgtagttcgtaccggtaggaaaccgggccgtaattcccaacctactcctacgacgaacgaactaacgtacccaataaacccgactaacgttctatacgttacgaaacctaaagtacgaaataaggtagttaggaagtacggcgttaacggaacggaccggtccggtaacgttggtttacgtttaaaccgttcgtaggttaacgaaacggtaaaccgtcgttaaggtcgggtaaggggttacgggggtttaaaaggggg

SEQ ID NO: 329496 - DNA, 669 bp, Homo sapiens
  misc_feature: GZ8MTXP02I10GD.51.76.G10.1.454.CMB.2.raw
  modified_base (194)..(194): a, c, t, g, unknown or other
  misc_feature (194)..(194): n is a, c, g, or t
  modified_base (526)..(526): a, c, t, g, unknown or other
  misc_feature (526)..(526): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcgaggggaanacgcccacctctcctgcgacgggccagtcaggtagtgttagcgagcgtacttagccgtacggtaccagacaacggaaaccgtcggaccacgggccctacccgacggtcctccgtacactctagtgtactcgactacgtaccgaaacggaaccgggaccctacgtacggtaacttacctccccggaacgtacccgtagggttaccgagggtcggacgttggggttcgggtacgtagggggtactaggttaccggttcctacgttcctaaaccaaccttacacgacgtaccacgtaccgtcgacttacggtacttaaggtaacgtttacgtttntaaactttaattttatcgttagtactacgtataattaagtaaacttcgtccgtaccttacgttactcgttacggacggtaggaccttagacgttaggaactacgtaacgaacggtacgtcgtacggtctacgacctacttacg

SEQ ID NO: 329497 - DNA, 668 bp, Homo sapiens
  misc_feature: GZ8MTXP02JZAQI.51.76.G10.1.454.CMB.2.raw
  modified_base (262)..(262): a, c, t, g, unknown or other
  misc_feature (262)..(262): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccaggcccggggaggtccctgacgacctctcctgtgcagcctntggacttcaccttcagtcgcctagtggcagtcgcctacggtcgggtccccaccgtagggcctccggaggcggaaagggggtctggggaggttggggtcgtactaattttagactcgaagtatgagtgggactaaaggttaaataaggtagtacgtagacgtacgtcccgtacgggtagggaaccgggtacccgttaatcccgaacctacgtacccgaccgaaaggacgtaacctaaaccgttacccaaacgtaaccactacgtacgtactactacgaataaagacgaaatatacgtagagagtacgaggtacggacgtacggtcgttagttagttctttacggacggtaagtaacccggtaaagtccgttaaggtacgggttaggggttacggggtttaaaggggg

SEQ ID NO: 329498 - DNA, 607 bp, Homo sapiens
  misc_feature: GZ8MTXP02ILQKD.51.76.G10.1.454.CMB.2.raw
  modified_base (256)..(256): a, c, t, g, unknown or other
  misc_feature (256)..(256): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcccgggagtccctgagactctcctgtgcagccctntggattcaccttcagtgcctatggcatgccacgtgggtcccgccgaggcctccgaggcgaaggggctgggaggtgggngctatttanatcagntgatggcagtaaanaaagagtatgctagtcctcgtaggaacggccgtatccacgtatcctacgagaacgactaacttaccccaaagaaaccactactagtactaccgtacgaactaaaatcggaaaactagtaagttaggaacggtagtaccggtaggaaacgggtaaacccgtacggggtcgttaacggttgtttaaccgtttcggtaggttaccggaaacggtaaaaccgtcgtttaacggtaggttaaagggggg

SEQ ID NO: 329499 - DNA, 638 bp, Homo sapiens
  misc_feature: GZ8MTXP02J1E5N.51.76.G10.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggcccgggagtccctgacgactctcctgtgcngcctntggattcaccttcagtncctatggcatgcacgtcgggtccnccaggcctccgagggccgtaaggggctaggggagtggggtgtactagttttaanactacgagtatgagtacggactagtaaaagtaaacggntagtcgtactacgtcccgtaccggtaggaacgggtaccgtaactaccaaccgtactaccgtaccgaagaaccgtaacctaaccgtaacccgaaagtaaaccctaacgtacgttagtacgttacgtacgaactaaacgtacgaacgtaagtagtacgaagtacgacggtaggacggaccggtacggtacgttacggttagttacgtttcgtacggtaacgtacggtaaacgtcgtacggttaggtagg

SEQ ID NO: 329500 - DNA, 559 bp, Homo sapiens
  misc_feature: GZ8MTXP02F23QE.51.76.G10.1.454.CMB.2.raw
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcacttcagtgcctatggcatgcacgtggccncaggcctcgaggcgaaggggctggagtgggngctattnatcagatgatggacaagtaanagcgtatgacagtctcggtagaacgggctattcgacctagtcctaccgagaacgactaactacccagaaacacacgtgtatcgtagactaaagcgaanagtatagagagcgtaggacggtacgacggtcttaggttacgttagtttcgtaggtaacggtacccgtaaaacgtctaaggttacggtaacgggttaggggttaaaggggg

SEQ ID NO: 329501 - DNA, 617 bp, Homo sapiens
  misc_feature: GZ8MTXP02GZUSX.51.76.G10.1.454.CMB.2.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
  modified_base (526)..(526): a, c, t, g, unknown or other
  misc_feature (526)..(526): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccccgggagtccctgagactctcctgtgcagccctgtggacttcaccttcagtgcctatggcatgccacgtcggggtccnccgaggcctaccgagggcgaaggggctaggggaggtggggnggactaagttttacatcagtatgagttagggacaggttaaaanaaaaggtgtaagtgacgtagtccgtaccgtggaaacgggccgtaattccaacctacgtacctaccgaacggaactaactaaaccgttacccaaacgaaaccactacgttagtaactactacgaacaaagtagaaaccgnggtaatagacgtaaggctaggacggacgacggtacttcggtattacgtttcgtagtaacggacgtaaacgtcttaacggtagtaacggggg

SEQ ID NO: 329502 - DNA, 580 bp, Homo sapiens
  misc_feature: GZ8MTXP02I730L.51.76.G10.1.454.CMB.2.raw
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctctgtgcagcctntgattccaccttcagtgcctatggcatcgcacgtgggtcccnccaggctccgaggccaaggggctggaggtgggtgctatttanatcagtatgatggacaagtaaatagntatgactagtctacggtagaacgggtccagttccacatcctacagagaactaacttacccaagtaaaccactaccttgtaactcgtagaaccaaaatgaaacagtatagagagtactaggacggacgtaccgggtattggttacgttacgtttcgtaggtaacgtaaaccggtaaaacgtcttaaggttacgggaagggtttagggggttaaaagggg

SEQ ID NO: 329503 - DNA, 632 bp, Homo sapiens
  misc_feature: GZ8MTXP02G8K8B.51.76.G10.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccacctgtctgtgtctccgaggggaaancgccaccctntcctgcagggccagtcagagtgtagcagcgacttagcctggtaccagcaacgaaacctggaccagggcctcccgaggcctccncatctatgatgcaactccgaagaacggccacgttagaacttacncccaagtccgtagggtttccaggtcggcgtaaggggttcgggtacgtgggggaacacggtaacgtttccaaccgtttcacaacccatacacgctacggcctcggtctacgtcgtagtaaagttagtttagaacttaagttttaacttacgtttagtactaggtactaagttaactaaacttaacgtacgtacccgttaccgttacgttacgttttacgggaccgtaacgggtaccgaacgtacgtacgtaacgaacgtaacgaaaacgtacgtacggtacggcttacggacctaactacg

SEQ ID NO: 329504 - DNA, 698 bp, Homo sapiens
  misc_feature: GZ8MTXP02GVYAP.51.76.G10.1.454.CMB.2.raw
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggccaggcccgggagtccctgagactctccgtgtcgcagtcctcgtggattcaccttcagtcgcctatggcagtgcacgtcggggccnccgagggcctaccgagggaccgaaagggggtctaggggagggtggggtcggacttaagttttanacgttacgagtatgagtggaactaaaggttaaaataaggtagtagtcgacgtacgtcgtaccgggtagggaacgggtacccgtaattcccgaaccgtactccctacccgaagaacgaactaaaccttacccaaagaaaccactaacttacgtaactcgacgtaacaaaagttacgaaactaagtaagtttaggaagtaacggtacgtaacgggaacgggaaccgtaccggggtacgttaggttacgtttaaacgtttccggttaggttaaccggaacgtaaaacccggtacgttaaggtacgggtacgggggttaacggggtttaaaggggg

SEQ ID NO: 329505 - DNA, 688 bp, Homo sapiens
  misc_feature: GZ8MTXP02J0LLD.51.76.G10.1.454.CMB.2.raw
  modified_base (188)..(188): a, c, t, g, unknown or other
  misc_feature (188)..(188): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggcccgggagtccctgacgactctcctgtgcagcctcgtaggtattccaccttcagtcgccctatcggacatgactacgtcgggtcccgcaggcctacgagggccgaaggggcctgggaggtcgggtagctagtttacactnagtataggatcggataagtaaaactaaaggagttagtgaccgtaggttccctaccggtaaggaacgggtcccgtacttaccgaccctattccgacccgaagaactaaccctaaacgttccccgaaagtaaacccaacctaccgttaggttaacccttacctagaaaccttaaaagtacggtaaaccaagtacgttaaggaacgtacggtaggtaacgaacggggttaaacccgagggttcccgttacggtttaacggtttatttaacccggtacgggttaacgaaaaccggtaaaccgttacgtaaaacggttcgggtaaaggggg

SEQ ID NO: 329506 - DNA, 586 bp, Homo sapiens
  misc_feature: GZ8MTXP02FJQ7B.51.76.G10.1.454.CMB.2.raw
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgagactctcctgtgcagcctctggattcaccttcagtgcctatggcatgcacgtgggtccnccaggcctccgaggcgaaggggctggggagtggggtgactatttanatcagatgatggactaagtaaataaggngtatggactagttctccggtaggaacgggcctagttccaacctatcgtaccgaagacgaacaacttacccaagaaaccacactagtatctagacaaatagaacagtattagaagagacgtaggaacggacgtacggtcgttaggttacgtttacgttcgtaggtaacgtaaccgtaaacgtacgttagtacgggtagggttacgggggttaaagggg

SEQ ID NO: 329507 - DNA, 638 bp, Homo sapiens
  misc_feature: GZ8MTXP02IT2KD.51.76.G10.1.454.CMB.2.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggnggcgtgggtccaggcccgggaggtccctgagactctcctgtgcngcctctgattcaccttnagtcgcctatcggcagtcgcacgtcgggtcccncgaggcctcgagggccgaagggggtctgggaggtcggggtggtactaagtttanagtcgagtagtgagtggacgtaaagttaaataagggtgttactggacctaggttccgtaccgggtagggaaccggggtccttaacttccgaaccctacgtccctaaccgaggtaacaacctaaacgtaccccgaataaaacctacctactagttacttccgagaaacctaaataccgaaataggtaattggagtacgcgtaaggacggaacgtcgtgttgttacgttactttcgtaggtcgaaacgtaacgtcgtagtacggtaggggtagggttaagggg

SEQ ID NO: 329508 - DNA, 677 bp, Homo sapiens
  misc_feature: GZ8MTXP02IMWQV.51.76.G10.1.454.CMB.2.raw
  modified_base (154)..(154): a, c, t, g, unknown or other
  misc_feature (154)..(154): n is a, c, g, or t
  modified_base (189)..(189): a, c, t, g, unknown or other
  misc_feature (189)..(189): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttccncgttgcttcttttaagaggtgtccagtgtcaggtncagctggtggagtcgtgggggagcgtggtccagcccgggagtccctgagctctctgtncagcctatggacttcaccttnagtgcctatggcatgcacgtgggtcccgcgaggctacccgaggacgaaggggtctaggggacggtggggtacggctagttttanagtacgagtatggaatgggactaggtaaataaaggtatagttcggcaggttccgtacgtagggaaacggggccctattcccaaccctaattccgtaacgaacgtaaacgtacctaaacttaccccgaaaagaacccgtaaacctacggttagtaactacgtacggtaaactaaaacgttgaaaaacgttatacgttaaaggaaaacggtgtacccttagggggaaaccttaaaccggcccgggttacgttaggtttaactttaccgtttgggtaacgtaccggaccgtaaaaacggttccgttaaaaggtcggggttaaaggggg

SEQ ID NO: 329509 - DNA, 620 bp, Homo sapiens
  misc_feature: GZ8MTXP02HW2KC.51.76.G10.1.454.CMB.2.raw
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggtcgtggtccaggccccggggaggtccctgagactctcctgtgcagcctcgtggattcaccttcagtcgcctanggcatgcacgtcgggtccgccgaggcctccgaggccgaaggggtctgggaggtggggtgctatttatancgagtagtgtagtggactaagttaaataaggtagtataggctacgtccgtaccggtaggaacggggtccgacttccacctactccgtacaacgaacgtaacaacttacccgaagaaaccacgtacctagtactcgtatacaaatagaacagtagttagagacgacgtaggacggaccgacgggtacgtacggtttgttaccttttgtacggtcgtaaaccggtaaacgtacgttaaggtaggtaaggggttacggggttaaaggggg

SEQ ID NO: 329510 - DNA, 602 bp, Homo sapiens
  misc_feature: GZ8MTXP02JUN4O.51.76.G10.1.454.CMB.2.raw
  modified_base (191)..(191): a, c, t, g, unknown or other
  misc_feature (191)..(191): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (379)..(379): a, c, t, g, unknown or other
  misc_feature (379)..(379): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaaggaggtgtccagtgtcaggtncagctgggtggagtcggtgggggagcgtggtcccaggccccgggagtccctgacgtacctctccgtgtgcagtccctgtaggtacttccaccttnagtcncctagtcggactagtcgacctacggtcgggtccccacgaggccctaccggaggcggtaaggggctagggaggtgggtgacttatttanactcgagtatggtagtggactaagttaaagaaaggtagtacgtagacgtagttcccgtacggaagggaaccggtcctataccaccgtatccaacgaagactaactaactaccgagtaaaccngtatcgttanacgtagaaactaagacaatagtatagacgatcgagacgacgacgtgtagttcgttagttcgagtaccgaacgtagtcgtaggtaggtaggg

SEQ ID NO: 329511 - DNA, 587 bp, Homo sapiens
  misc_feature: GZ8MTXP02JICIT.51.76.G10.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
  modified_base (444)..(444): a, c, t, g, unknown or other
  misc_feature (444)..(444): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtccctgacgactctcctgtgcagccctntggattcaccttcagtcgcctatggcatcgccacgtcgggccnccgaggcctaccgagggcgaaggggctgggagtggggtcgactaatttanactcagatggatgggactaggtaaataaacggngttatgactagtcgtacgtagaacggctatccacatccacagacactaacttaccgaanaaaccactacctagtacttaccagaactaaagtagaaactagtaagtaggaacgaggtacgtagggaaacggacacgggttccttaggttagtttacttcgtacggtacggaaccgtaacgacgtttagaggggtttaagggg

SEQ ID NO: 329512 - DNA, 739 bp, Homo sapiens
  misc_feature: GZ8MTXP02IX62C.51.76.G10.1.454.CMB.2.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
  modified_base (698)..(698): a, c, t, g, unknown or other
  misc_feature (698)..(698): n is a, c, g, or t
  modified_base (726)..(726): a, c, t, g, unknown or other
  misc_feature (726)..(726): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtncagctggtggagtcgtgggggagcgtggtccaggcccgggagtcccngacgacttctcctggtcgctaggccctgtggtacttccacccttcgagtgaccctagcggacatcggcctacggttcggggcccctaccgaggtcccctaccggacgggtacggaaagggggtccgtaggggagggttcgggggtacggtacctaaagtttttacgaatccgaaaggttataggggtacgtaggggacctaaagggttaaaataaaagggtagttagtacgaacttcgggtccgttaccgggtaagggaaccgggtaccctaacgtttacccgaaccctatcccgtaacgtaagaaacctaaaccttaccttaacccgaaaacgtaaccaaacccgttattacttaacggtactaaacggtaactaaaacgtaacgtaaaacgagtaaattagaacggtagacgtacgggaggtaaacggccggtagtttacggtactttagttaaccgnggtaacgtaccgaaagtctttaaagggngtttaaacggggg

SEQ ID NO: 329513 - DNA, 618 bp, Homo sapiens
  misc_feature: GZ8MTXP02GLML0.51.76.G10.1.454.CMB.2.raw
  modified_base (190)..(190): a, c, t, g, unknown or other
  misc_feature (190)..(190): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggcccgggagtccctgagactctctgtgcagcctntggattcaccttnagtcgcctatggcatgcacgtcgggtcccgccacggcctaccgaggccggaaggggcttggggaggttcggggtggactattttactactgaagagttcgaagttcgggaactaaggttaaaagtaaaaggtaggttaaatggactagggttaccctccggggtaggaaacgggggtaccctagttcccaaccgtactcctacgagacaactaactaccccaagaactacgtactacgtacttcacgaacaaagtacgaaatgtaagttagagtaacgcgtaggacggtacgacgtcgttagttcgtttattcgtgtacgacggtaaagtcgtaagtcgggtaagggg

SEQ ID NO: 329514 - DNA, 597 bp, Homo sapiens
  misc_feature: GZ8MTXP02FZIS8.51.76.G10.1.454.CMB.2.raw
  modified_base (486)..(486): a, c, t, g, unknown or other
  misc_feature (486)..(486): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagtagtgttagcagcgtacttgcctggtaccagcaagaaccgtggccaggcctcccgaggtcctcctcactctatgatcgcactaccaacggaacggccagtgtactacctaccgacggtcctagggttaccagggtcggacgtaggttcggggtacgtgggggacacgggtactttaccaactcctaccacgtactcgacgcgaacgtccgtgacgtacgtcgtaagtagttacgtttagtacctttaaatttacttacgtntacgagtactaagttaataactacgtcgtacctacgtacgtacgtttcggacgtacggactacgacgtacggatacgtaacgaacgtacgttagacgtcacgacacgtacg

SEQ ID NO: 329515 - DNA, 510 bp, Homo sapiens
  misc_feature: GZ8MTXP02IYQYY.51.76.G10.1.454.CMB.2.raw
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagctctcctgtgcagcctctggattcgaccttcagtcgcctatggcatgcacgtggtccgcaggctccgaggcgaaggggcttgggagtgggtgctatttanactcagatgatggacagtaaataaagngtangacagtacncgtagacggcgatcacgatccgacagacacaacgtacccaagtaacactactactntacgtanacaaatgaaacngtatgatgacgtgaacgacngcgtagtgtattcgtatcgacaacggtntagtagagg

SEQ ID NO: 329516 - DNA, 835 bp, Homo sapiens
  misc_feature: GZ8MTXP02FVHDH.51.76.G10.1.454.CMB.2.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccacctctcctgcagggccagtcagagtcgttagcagcgtacttagccgttggtaccagcaagaaacctggaccagggcctcccgaggcctcctcatctatgatcgactactaccaacggaacggggtcccaacgtcgtaaacttaaccgtccccgaacggtacccgtaacggggtttacccgaggggttcgggtacgggtaacggggttcgggggttaccgtacggggggaaacctaacggggttacggttttacccgaaacctttcccgttaaaccaaccccggttaaattcccgaaacgggtccaaaccgggtcccttacggtaccgtacgggttaccgtaaagggttaaacggtttaatttttacggtaaacctttttaaatttttaaccggtttaaccttagggttaaacccctaggttaaccgttaaagggtttaaacttaaaacggtttaacccggttacgggtacccccctttaacggtttaacccgtttacgggtttttaccggggaaccccgggttaaagggggtaaacccctaaaagggtccggtaaacgggtaaccggttaaaacctaacggtaaaaccgaacgggtttcggtaccggggacttaccggaacctacttaaccgg

SEQ ID NO: 329517 - DNA, 592 bp, Homo sapiens
  misc_feature: GZ8MTXP02FGIYW.51.76.G10.1.454.CMB.2.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggaggtcctgagctctctgngcngctgtgnttcactnagtcnctatgcatgcacgtggccccncgaggcctaccgaggcgaaggggctgggagtggggtagactagttatactcgagtatgacgtggactaaagtaaataagngtatgcctagtccgtacgaagggtaaacggcctattcccgaactagtcccaccgaagtacaactaactaccccgaaagaaaccactacgttgtaactccgtaagaacaaaagtgaaacaggtataggagagtacgaggaacggtaccgaacgtcgttagttaagttacttacgaggaaccgtaaacgaacgttctaagggtcggaaggggtgggtttaaacgggg

SEQ ID NO: 329518 - DNA, 647 bp, Homo sapiens
  misc_feature: GZ8MTXP02JAZFG.51.76.G10.1.454.CMB.2.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacaggggggagaggagcccagcactagaagtcggcggtgtttccattcggtgatcagcattgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtcgcagcctctggacttccaccttnagtgcctagtggcagtcgcacgtcggggtcccnccgagggcctaccgagggtccgaaggggctaggggacggttggggtcggctatttttanacgttcaaggtatgaagttcggggactaaaggttaaaataacgggtataagtcgacgttagtcgttcccggtagggtaaacggggtccctaattcccaaccgtctaccgtaccgagtaacgaacctaaaccgttacccaaagtaaaccaacgtacgtacgttatctacgaactaatacgacaagtatagaacgtagcgtacggaaggaccgacggtacgttgttgtttaacgttcgtaggtccgtaacgaaacgtcgtagtaggtaacgggttaggggtaaggg

SEQ ID NO: 329519 - DNA, 563 bp, Homo sapiens
  misc_feature: GZ8MTXP02H3TQH.51.76.G10.1.454.CMB.2.raw
  modified_base (187)..(187): a, c, t, g, unknown or other
  misc_feature (187)..(187): n is a, c, g, or t
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccagcccgggagtccctgagactctctgtgcagcctcgtggtacttcaccttcagtcgcctagtggcagtcgcaccgtgggtccccncgaggcctcgaggcgaggggcgtgggagtggggtgctatttanatcagntgatggataagtaanagtgtatgacagtctaccggtaggacggcatccacatctacagacgacaactacccagaaccacactagtactctagactaaagtagaaactagtaaagttgaagtacgcgtaggacggaccgtacggtgtagtttcgttatttcgtagttaacggacgtaaacgtctaggtacggtagggttaggggtaacgggg

SEQ ID NO: 329520 - DNA, 663 bp, Homo sapiens
  misc_feature: GZ8MTXP02JHDTE.51.76.G10.1.454.CMB.2.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggcccgggagtccctgagctctcctgtgcagcctntggtacttccaccttcaggtcncctagtcggacagtcgcctacgtcgggtcccgccgaggcctaccgagggtacgaagggggtcctaggggtaggtggggtcgactaatttagactacgagtntaggagttggaactaggttaaaagtaaaagtcggtttaacngtacgtaacggttcgtaccgggtacggacggtaccgttactaccgactactcctaacgaacgaccaacctaacctacccgaaacgtaacctacctacgttataacgtactacgaacgtaaacgtacgaaacgtagtaagtacgaggtacgtacggtaacggaaccggtacgtaccggttcgttacggttacgttacgtttaacgtagtacggaaccgtaacgtagtacggttaaggtagggg

SEQ ID NO: 329521 - DNA, 548 bp, Homo sapiens
  misc_feature: GZ8MTXP02GRWBM.51.76.G10.1.454.CMB.2.raw
  modified_base (334)..(334): a, c, t, g, unknown or other
  misc_feature (334)..(334): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcccgggagtccctgagactctcctgtcgcagcctctggattcaccttcagtgcctatggcagtgcactgggtccgccaggctccaggcaaggggctgggagtgggtggctatttanatcagatgatggacaagttaataagagtatgactagtctccgtagaaggccgattccacatctaccagtaagacaattcccaagaaacacaactgtactactcganaaaactgaaaanaagtagtagagagagacggacggacgacgtacgtacgttacgttacgtttcgttagtaacgtacgtaaacgtacgtagtaggtaggtagggtaggg

SEQ ID NO: 329522 - DNA, 782 bp, Homo sapiens
  misc_feature: GZ8MTXP02I4VI5.51.76.G10.1.454.CMB.2.raw
  modified_base (169)..(169): a, c, t, g, unknown or other
  misc_feature (169)..(169): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctgggtggagtcgtgggggagcgtggtccaggcccgggaggtccctgacgtactctcctgtgcagcctnggtattcaccttnagtcgcctagnggcatgctacgtcggcccncgagggtccctccggaggacggaaggggtctaggggtaggtggggtcgacttaagttttacacttacgagtagtaggtacgttacgggacttaaaagtaaaagtaaagggtccgttaagtccgtacgtaaccgtttccgtaaccggggttagggaaaccgggggtccttaaacgttaaccacccgtacttacccgtaaacgccggttaaaacgacccgtaaacttacccccgaaaggtaaaacccctactaacggttacttaactacggtaaacgtaaacgtaaacgtaaacgtaaacgtaaggtaacgtaacggaacgtaacggtaacgggtaaacgggtaaccgggtaacccgttcgggttaacggtttacggtttacgtttacggttaaccggttaggtaaaccggtaaaaccggttaaccgttacggttaagggttaccgggggtaaacgggggttaacgggggtttaaaaggggg

SEQ ID NO: 329523 - DNA, 610 bp, Homo sapiens
  misc_feature: GZ8MTXP02F40WX.51.76.G10.1.454.CMB.2.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggaggtccctgagactctcctgtgcagcctcgtggattccaccttcagtcgcctatggcatgcacgtcgggcccncaggcctccgaggcgaaggggctgggagtggggtgctaatttanatcagtatgagtaggactaaagttaaagaagagtatggctaagtcgtacggtaggaaacgggcctaaattccaacctntacccgtacgaaggacaacctaaacttaccccaaagtaaacccactacgtacgttaacaccttaggaaactaaaacgttgaaactaagtagttagaacggtagacgtaggaacggtaccgacgggtacttggtacgttatttcgtaggaacgaaccgaaacggttctagtaggtagggtagggtaagg

SEQ ID NO: 329524 - DNA, 593 bp, Homo sapiens
  misc_feature: GZ8MTXP02FOYJ7.51.76.G10.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (504)..(504): a, c, t, g, unknown or other
  misc_feature (504)..(504): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctgttgcttcttttaagaggtgtccagtgtcaggtgcagcgtggtggagtcgtgggggagcgtggtccaggcccgggagtccctgagacctctcctgtgcagcctctggattcaccttnagtcgcctagtggcatgcacgtgggccncaggcctccgaggcgaaggggctgggaggtgggtggctagtttanacttcgagatgagtcgatagtaaataaagagtatgacgtagtccgtacggtaggacgggtccgtaattccgaacgtactcccgttacgaagtacaaacgtaacttaccccgaaagtaaaccacgtacttcgtaacttcctaacgaaccaaaatcgaaanagttagtagaacgtacgacgtagaacggaccgacggtcgttagtagtttacttcgtgtacgaaccgtaatacgtaggtaggtaacgggg

SEQ ID NO: 329525 - DNA, 568 bp, Homo sapiens
  misc_feature: GZ8MTXP02HGQ5X.51.76.G10.1.454.CMB.2.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcgagggaaangccacctncctgcaggccagtcagagtgtagcagcgattagcctggtaccagcagaaacctggccaggcctacccaggcctacctcaatctatgatgcatccaacgaaggcccatgactactccagccaggttccaggtcgacgtaggttcgggcgtacggggaccaggtaactttccgaaccttcgtaccacctatacaacgcgacgtccctgacctaggtactagaagttntttacgacttaaatttattacttgtactagtactaagtaataactacgtcgtacctacgttactacgtttacggacgtagggaccaaagtcgtacggatacgtaacgtaaacgtaacgtgtacggtgtacgtacacgtacg

SEQ ID NO: 329526 - DNA, 619 bp, Homo sapiens
  misc_feature: GZ8MTXP02FK2JH.51.76.G10.1.454.CMB.2.raw
  modified_base (189)..(189): a, c, t, g, unknown or other
  misc_feature (189)..(189): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (420)..(420): a, c, t, g, unknown or other
  misc_feature (420)..(420): n is a, c, g, or t
  modified_base (546)..(546): a, c, t, g, unknown or other
  misc_feature (546)..(546): n is a, c, g, or t
  modified_base (589)..(589): a, c, t, g, unknown or other
  misc_feature (589)..(589): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtncagcgtggtggagtcggtgggggaggcggtggtccaggcccgggtaggtccctgacgactctcctgtgcncgcctgtggtacttccaccttcagtcgcctagtggcagtcgcacggttcggggcccnccgaggtcctaccggagggccggaaaggggtccgtaggggagggttcggggtaggacttaaagttttagaaccctcgagtaagtgagtacggaataaggtaaanaaacgtagtatcgatacgtcgtacggtagacgggactatcaacctatcctaacgaagtaacaacctaaccgttacccaaacgaaacctactaacgttgtaactacaacgtaaactaagacgtaaanagtagtagagaacgtgacgacgacgtacggtctacggtaattntgtgacgtacgaagtgtagtggggtaaagg

SEQ ID NO: 329527 - DNA, 705 bp, Homo sapiens
  misc_feature: GZ8MTXP02HGEQG.51.76.G10.1.454.CMB.2.raw
  modified_base (370)..(370): a, c, t, g, unknown or other
  misc_feature (370)..(370): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcggtgggggaggcgtggtccgaggcccgggaggtccctgacgactctccgtgtgcagcctgtggacttccaccttcgagtcgcctagtggacagtcgccgtacgtcgggtcccgaccgaggccctaccgagggacgaaggggctgggacggtggggtgactattttanactcgaagagtgagtggactaaggttaaaataaaaggtagttaagtcgacgtacggtttccgtaccggtaaggaaacggggtcccgtacgttacccaaccctaacgtcccgtaaccgtaaacggaaacgtaaacccgtaaaccttacccccgaaaggtaaaaccctaaccgtaacttacgttaacttaccgtagaaactaaaacgtagaaaacgtagtaagtacgaaggtacgacggtaggaaacggtaaccgaacggttcgttacggttagtttaacgtttcggtacgggttaacgaacccggtaaaacgttcgtaacgggttaggtaaggggg

SEQ ID NO: 329528 - DNA, 694 bp, Homo sapiens
  misc_feature: GZ8MTXP02FFS7B.51.76.G10.1.454.CMB.2.raw
  modified_base (173)..(173): a, c, t, g, unknown or other
  misc_feature (173)..(173): n is a, c, g, or t
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgtgctcttttaagaggtntccagtgtcaggtgcagctggtggagtcgtgggggagcggtggtccaggcccgggagtccctgagacctctccgtgtgcagcctcgtggtattccaccttcagtcgcctatggcagtcgcctacgtgggtcccnccgaggcctaccgaggtcgaacggggtctaggggacggttggggtcggctaagtttttanaacgttcaggtagtggagttacggaagtaaggtaaaagtaaaacgggtgttaaacgtgacgtaacgttccgtaacccgggtaagggaaaccgggtacccgtaactttacccgaaacccgttactcccgtaacccgaaaggtaaccgtaaacctaaaccgttaccccgaaaagaaacccgtacctaacgtagttaactacgtacgaactaaaagtacaaacgagtaagttaggaaacgtagtaccgtaggaacggaccgtaacggtcttaggtacgtttagttcgtacgtacggaaaccgtaacgtacgtaaggtagggttaaggggg

SEQ ID NO: 329529 - DNA, 673 bp, Homo sapiens
  misc_feature: GZ8MTXP02FKNKX.51.76.G10.1.454.CMB.2.raw
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccacctgtctgtgtcncgaggggaancgccacctctctgcgacgggccagtcaggagttgttagcagtcgacttagcctggaacagacgaacgaaccgnggaccgacggcctacccgcggtcctccctacacttatacgtgtacgtgacctactacccgaacggaacggtaccacgtgactacctccgacgtacgtacggttaccgagtcgacggtagggttacggggtcgtcggggacttaggtacttaccgcctacgtaccaccgtaatgaccgcgtagtcctagtacgagttacgtaaggttaatttacgtttaacgttaactttaaagtttatacggtactacgtagtaattaaacgttaaacgtaactaccggttaccgtacccttaagtttacggtaacgtttacccggggacgtaaacgggtaccgtaacggtacgtacggaaaccgtaagtaaaccgtaaacgtacgtcggtacgtcggactaaccgtactaccg

SEQ ID NO: 329530 - DNA, 792 bp, Homo sapiens
  misc_feature: GZ8MTXP02GSXYB.51.76.G10.1.454.CMB.2.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagcgatcgtatacacgaccggtgctcgatttagtcactcatacgagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcccgggaggtccctggagactctcctgtgcagtcctntggtattccaccttnagtcgcctagtcggcatgcctacgtcgggtcccnccaggtcctaccgagggccgaaggggtctggggaggttgggtaggtacttaagtttagacttcgaaggtatgagtagggacgtaaaggttaaaagttaaggagtttaacgnggtacccttaacgggttcccgttaaccgggggttaacgggaaacgggggtcccgttaaactttccccgaaacccttacgttacccgttaaccccgaaagggtaaccgttaaacccgtaaaccctttacccccggaaaagtaaacccctacgttaaaccgttaggttaaaccttcggtaaacgaacctaaaaagtaccgaaaacgtaggttaaacgttaggaaggacgttaaccggaaggggacccggtaagtacccgggttacggttacggtttacggtttaaacttttccggtaagggtaaccggttaaaacccggaaacggttacgtttaacggaggggtaacgggggtttaccggggtttaaaagggggg

SEQ ID NO: 329531 - DNA, 793 bp, Homo sapiens
  misc_feature: GZ8MTXP02GI1U1.51.76.G10.1.454.CMB.2.raw
  modified_base (277)..(277): a, c, t, g, unknown or other
  misc_feature (277)..(277): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcggtgggggagcgtggtccaggcccgggagtccctgacgactctcctgtgcagcctctggacttccaccttcagtcncctagtcggctatcgccacgtcgggtccccgccgagggccctaccgagggccggaaagggggtccgtaggggtagggttcggggtaggtaccttaattttaacgtagtcgaaaggtagtggaagtggactaaaaggttaaagtaaacgggtgttaagtgaccgtacggttacccgtacgggtaaggggaaaccgggtccctaacgttacccgaacctaccgttacccgtacccgaaggtaaacgtaaacccgtaaaccttaacccccggaaaactaaacccgtaaccgtaacgttacgttaactacccgtaacgtaaaactaaaacgttaacggaaacgtaacggttaagtaacgggaaacgtacgggtacggttaaacgggggaaaccggtaccggtaaccgggtttagtttacggtttacggtttaacgtttcggttaacgggtaaccggtaaaccggttaaaacgttacggtaaggttacgggggttaacggggttagggggtttaaaagggg

SEQ ID NO: 329532 - DNA, 643 bp, Homo sapiens
  misc_feature: GZ8MTXP02FGSIW.51.76.G10.1.454.CMB.2.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtcgtgggggagcgtggtccaggcccgggaggtcccctgagactctcctgtgcagcctcgtggacttcaccttcagtgcctatcggacatgcacgtggtccnccaggctccgaggcaaggggctggaggtgggtgctatttanctcagatgatggctagtaaacgtaaagagttagtcgactaacggttcctacccggtaggaaacggggcccgtaattccgaacccacttaccgtacccgaagaacgtaacctaaactttacccccgaagaaaccaccaaccgttgttaaacttcgtaacggaactaaaacgtacggaaacaagtaagttacgggaagaacggtcctagggaaacgggtaacgacgggtaccgtttacggtagtttaatttaaccggtggttaacggaacgtaaaaccggtactaacggtcggtaaaggggg

SEQ ID NO: 329533 - DNA, 557 bp, Homo sapiens
  misc_feature: GZ8MTXP02GQF7J.51.76.G10.1.454.CMB.2.raw
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacaggggtgatcaggactcctcagttcaccttctcacaatgaggctccctgctcagctcctggggctgctaatgctctgggtctctggatccagtggggatattgtgatgactcagtctccactctccctgcccgtcaccccgtggacgacgccggcctccatcctcctgcaggtctagtcagacgcctctgcatagtatgatacaattnttggatgcactgacagacncgaggcagtctcactggtcngtntcttattgagttctacgtccccgggccccggtctgacgtgtcagtcggctagtgntcgagcatagttatttanacgtanaaaatcgagactagaggtggacgacggtagagggttagtttacggggttttagggttcagttattcggatagtcgactacgtacttaccaaaccgtaaacttccgttagttaaccggtacgttccggggacggaacggtaccgtaagggaacgtacgtaagacgaaacgtcgaacggtgtacg

SEQ ID NO: 329534 - DNA, 705 bp, Homo sapiens
  misc_feature: GZ8MTXP02GXN9D.51.76.G10.1.454.CMB.2.raw
  modified_base (251)..(251): a, c, t, g, unknown or other
  misc_feature (251)..(251): n is a, c, g, or t
tcagcgatcgtatacacgaccggtgctcgatttagtcactcatacaggggtgatcaggactcctcagttcaccttctcacaatgaggctccctgctcagctcctggggctgctaatgctctggtctctggatcagtgggatattgtgatgactcagtctccactcctccctcgcccgtcaccccgtggagacgccgcctccatcctcctgcaggtctagtcagacgccctctgcatagtatgatacaattnttggatgcactgcaagacgccgagggctagtcctaccacgtacggttcctagtacttacgttagttttacgacggtttaccgtaacggtcccccccgggggtcccccccggggttacctacggaaaccgttgggtttaccgaggggttcgggaccgttaaagggtcggtactacggacgggacctaaagttaagtttaactttttaaaggtacctaaaaggtaaaaactccgaagtacgaaggtaagggtgggaccggtagtagggtacggttaggtttaggggtttacggggtttatagttagttacgaagtagttcggaactagttaccgttactaaaaccctaaccttcgttaccggttaacgtttaaccggttacggggaacggggtaaccggaaacgttacggggtaagaacgtaagttaaccggaaggtaccgtaaggttcggtacgg

SEQ ID NO: 329535 - DNA, 499 bp, Homo sapiens
  misc_feature: GZ8MTXP02FH8ZE.51.76.G10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (413)..(413): a, c, t, g, unknown or other
  misc_feature (413)..(413): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctnatctangatgcatccanaaagggccactgatatcccagccaggttcagtgcagtggctggggacagagttcactcgtcacatcagcagcctgcagtctagaagattttgactaatttattactgtcagnagtataaataactggcctcgtacacgtttcggactaggggaccaaggctaggacgatacgaaaacgaactgtcggctcgacactac

SEQ ID NO: 329536 - DNA, 636 bp, Homo sapiens
  misc_feature: GZ8MTXP02GIO8J.51.76.G10.1.454.CMB.2.raw
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctctgtgcagcctctggacttccaccttcagtcgcctatggcatcgcacgtggggtcccnccagggcctccgagggccaagggggctgggaggtgggtcggctagtttanagtcagtatgagtggactaagtaaataaggntaacgtgactaggtcctcggtagaacggggcctacttaccaaccgtactcccaacgacgaactaaacctacccaacgaaccaaacgtacctacgtactacgtactaacaaactaaacgtaacgtaaactagttaacgaggaacgtagacggtaaggaccgggaacgtcggtaaggtttacgttacgtttacgttacggtacggtaacgaacggtaacgttacggtagggtaggttaggggtaaggggttaagggg

SEQ ID NO: 329537 - DNA, 660 bp, Homo sapiens
  misc_feature: GZ8MTXP02GML71.51.76.G10.1.454.CMB.2.raw
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagcttgggttttcctcgttgctcttttaagaggtgtccagtgtcgaggtgcagctggtggaggtcgtgggggaggcgtggtccgaggcccgggaggtccctgagactctcctgtgcagcctgtgacttcgaccttcagtcgcctagtgctgngcncggtccggccgcaggcctccgaggcgaggggcgtggagggtggngntatttanactcagtntaggtactggactaagtaaagtaaagtgtaangacgtagtccgtacgtcggaacggtccgtactacaccgtactccgaccaacgaacgtaactaaccttacccaagaaactaccgtaacttagtacgtactagaaacctaacgaagtaaaccgaaaggacgtttaggaaacgtacgtacgtaacggggtaaacggaaccgtaccggtagttaacggtttagtttaaaccggtttccggttaacggaacccggttaaagggtaaaaccccttacgggttacgggttaaaacgggtttaagggggg

SEQ ID NO: 329538 - DNA, 646 bp, Homo sapiens
  misc_feature: GZ8MTXP02IML0I.51.76.G10.1.454.CMB.2.raw
  modified_base (309)..(309): a, c, t, g, unknown or other
  misc_feature (309)..(309): n is a, c, g, or t
  modified_base (572)..(572): a, c, t, g, unknown or other
  misc_feature (572)..(572): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagttttgggctgagctgggttttcctcgttgcttcttttaagaggtgtccagtgtcaggtgcagctggtggagtcgtgggggagcgtggtccaggcccggaggtccctgagctctcctgtcgctacgcctcgtgtacttccaccttcagtcgccctagtcggcatcgacacgtcggggtcccnccgagggcctcccaaggggacccgaagggggtctaggggagggttggggtcgacttaagttttacagttcgaagtacgtgtagttaggacctaaaggttaaaagaaggtgtaactggacctacgttcgtaccggtggaaaccggggtccttacgttaccacctagtccctacgaacgtaacgaacctaaccttacccgaaataaccccaataccgttagttaaccttccgagaacctaaattagaactagtaagtgaagacgngtacggacgacgcggtacgttgtagttactttcggagaacgtaacgtaacgcttagtggtaggtagggttaagg

SEQ ID NO: 329539 - DNA, 579 bp, Homo sapiens
  misc_feature: GZ8MTXP02HO543.51.76.G10.1.454.CMB.2.raw
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (536)..(536): a, c, t, g, unknown or other
  misc_feature (536)..(536): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctntggacttcaccttcagttcgcctagtggactagtcgctacgtcgggtcccgcccaggcctccgaggaccgaaggggctgggaggtcggggtagctatttacagtcagtntgagtggactagtaaataaagntatgctagtcncgtgacggctatcaccatctacgagaacgactactaccaacgaacacgtactagtactacgtacgaactaaagacgaaacgtaagtaagttaggacgtaacggcgttaggacggtaacgacggtcgttacgttagttntttcgtaggttacgaccgtaaaacgcgtaagtaggtaacgggg

SEQ ID NO: 329540 - DNA, 662 bp, Homo sapiens
  misc_feature: GZ8MTXP02JVT5A.51.76.G10.1.454.CMB.2.raw
  modified_base (249)..(249): a, c, t, g, unknown or other
  misc_feature (249)..(249): n is a, c, g, or t
  modified_base (381)..(381): a, c, t, g, unknown or other
  misc_feature (381)..(381): n is a, c, g, or t
  modified_base (650)..(650): a, c, t, g, unknown or other
  misc_feature (650)..(650): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgggagtccctgagactctctgtncagcctctggattccaccttcagtcgacctatcggacaattcggacctacggtcggggtccccgaccgtacggcctacccgaaggaccggaaagggggccttaggggagggtggggtcggactaagttttanactacgaggtatagagtggactaagtaaaataaaaggagttaagtcgacgtaagttcccgtaccggtagggaaacggggtccctaattacccgaacctacttccgaccgaaggtaacaacctaaacttacccgaaagaaaccactagtacgtactactagaactaaagtacggaaactagtaagttaggaaagtacggacgtaagggacggtaaacgacggttcgttagttacgtttaatttcgaggtacgaacgtaacgtcttaaggnggttaaaggggg

SEQ ID NO: 329541 - DNA, 666 bp, Homo sapiens
  misc_feature: GZ8MTXP02FNI69.51.76.G10.1.454.CMB.2.raw
  modified_base (167)..(167): a, c, t, g, unknown or other
  misc_feature (167)..(167): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctgttgctcttttaagnggtgtccagtgtcaggtgcagctgggtggagtcgtgggggaggcgtggtccaggcccgggagtccctganactctctgncngcctntgcttcncttnagtcnctagtggcagtcgcacgtcgggtcccncgtaggcctacgaggacggaaggggcgtgggagggtgggtcggtacttagtttatactcgaagtagttagacgtaggaactaaaggttaaaataacggtagttatacggtacctagttccgtacgggtagggaaacggggtccctaacgtccctaacctaacgttccctaccgaagtaacctaacctaaccttacccgaaagtaaaccactactagtactcgagaaactaaagtacaaagtagtaagtaggaaacgtgtaacgacggaacggaccgtaggttacgttagggttaatttaccgttagtacggttaacgaaacggtaaaccgtcgttaggtacggggtaggggttacggggtttaaaggggg

SEQ ID NO: 329542 - DNA, 878 bp, Homo sapiens
  misc_feature: GZ8MTXP02H5W7E.51.76.G10.1.454.CMB.2.raw
  modified_base (160)..(160): a, c, t, g, unknown or other
  misc_feature (160)..(160): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagcttgggtttcctcgttgctnttttaagaggtgtccagtgtcaggtgcagctggtggagtcgtgggggagcgtggtccaggcccgggtaggtccctgacgtactctcctgtacgcagtccctgtacggtacttccacctttcgaggtcgtacccttaagtcgggactaaggttccggacctaccggttcggggtacccccgaccccggtaacggggttccctaccggaacggggtacggaaacggggggtccgttagggggaagggttcgggggtaggtaccttaaagtttttacgaagttccgtaaagagttaccgggagtaccgggtaataaaaggttaaaaataacgggtgttaaattcgggaccgttaaaggttcccgtaaaccggggtaggtaaaccggggtacccgtacttacccgaacccgtaacttacccgttaaaccccaaggggttaaacgtaaccctaaacccggtttacccccaaaacggttaaaacccaccttaaaccggttacggtttaaacttaccggtaaccttaaacgaaaagttaaccggaaaacgtaacgtaaacggtttacggaaagaacgttaacggtacggggaaaccgggaccggtaaaccggtcgtttaaacggtttccgtttaagtttttcccggaggttaacggtaacccggtaaaaacggtttccgtaaaggttaacggggttacggggttaaaacgggggtttaaaggggg

SEQ ID NO: 329543 - DNA, 640 bp, Homo sapiens
  misc_feature: GZ8MTXP02G9H9G.51.76.G10.1.454.CMB.2.raw
  modified_base (169)..(169): a, c, t, g, unknown or other
  misc_feature (169)..(169): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctgggtggagtcgtggggggagcgtggtcccaggccccggggagtccctgagactctcctgtgcagcctntggattcaccttnagtgacctatggcatgacnctcggggtccncaggcctcgaggcgaaggggctggggagtggggngctagtttanatnagactgagtggactaagtaanagggatactgctagttacgcgtaggacgggtccaattccacctagttccaccgaggacaacctacgttacccaagaaaccacgtacttacgtatccgtagaaccaaaagttccgaagtaagtattaggacccggttaaagccgttagggaaaccgggtacgtaaacccggggtttgttacggtttacgtttaaccgtttcggttaacggtaaccggtaaaccgtaaaggtacgttaaggttacggggtaacggggttaaggggtaaggg

SEQ ID NO: 329544 - DNA, 708 bp, Homo sapiens
  misc_feature: GZ8MTXP02FHNK5.51.76.G10.1.454.CMB.2.raw
  modified_base (267)..(267): a, c, t, g, unknown or other
  misc_feature (267)..(267): n is a, c, g, or t
tcagcgatcgtatacacgaccggtgctcgatttagtcactcatacaggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcggtggtccgacggcccgggagtccctgagacttctcctgtgcagtcctctggtnttccacttcagtgcctatggcatcgcctacgtcgggtcccgccgtacggtcctaccgaaggccggaaagggggtccctaggggtacgggttggggttcggacttaagtttttaagacttacgaagtagtggtaagtggggaaccttaaggtaaaagtaaaaggtacgttaaagttcgaacgttcgtaccgttacccggtacgggaaacgggtcccgtaacttacccgaaccctactccgtacccgaacgacgtaaaacctaaacgttacccccgaaacgtaaacctaacctaacttacgttacacgttacgtaactaaaatacgaaacgtaagtaagttagaagtaacgacgtaaggacggaacgacggttaccgttaggttagttaacgtttcgttacggttaggtacccggtaaagtacgttaaggtacggtaaagggg

SEQ ID NO: 329545 - DNA, 566 bp, Homo sapiens
  misc_feature: GZ8MTXP02GUNFF.51.76.G10.1.454.CMB.2.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttagcagcgacttagcctggtaccagcagaaccnggccaggcncccaggcctcctnatcatgatgacatccgaacgaacggcccatgactacncccaggcctaggttcaggtcggactagggtacgggtctggggaacagggtacgttacaccgttctacacctacgtcagcaacgcctgacacgtctagaagttactttgacttaatttacttactgtacagtacaagttaataatacgtacgtcctaccgtactacgtttacgggaccgtaggggacctaaggcgtaggacgtaagtaacgaaacgtacgtcgtacggactacggtaccacgttacg

SEQ ID NO: 329546 - DNA, 549 bp, Homo sapiens
  misc_feature: GZ8MTXP02FWR9J.51.76.G10.1.454.CMB.2.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacaggggggagaggagcccagcactagaagtcggcggtgtttccattcggtgatcagcactgaacacagaggactcaccatggagtttgggctgagctgggttttccncgttgctcttttaagaggtgtccagtgtcaggtncagctggtggatcgtgggggagcgtgggtccagcccgggaggtccctgagctctcctgtcgcagccctntggattcaccttnagtgctatggcatgcatgggtccnctagctccaggctaaggggctggaggtggggnggtcagtttaanatnagtatgacgtgacaagttaaatagntacgngactgtcgtacgngaacgctatcactatccacgagacaactactaccgaagaacactactcgtatacgtagaactaaagtagaacagtaagtcgtagacgtgtacgacggacgacgtacgtacgtacgttacgttacgttagtaacgtacgtaacgtacgtacgtacggtaggtaggtagg

SEQ ID NO: 329547 - DNA, 622 bp, Homo sapiens
  misc_feature: GZ8MTXP01D154G.39.34.D01.1.454.CMB.2.raw
  modified_base (260)..(260): a, c, t, g, unknown or other
  misc_feature (260)..(260): n is a, c, g, or t
  modified_base (369)..(369): a, c, t, g, unknown or other
  misc_feature (369)..(369): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatggaattcagtagactgaagtccaacgacacggccgtgtacttctgtgcgagaggcagagttccacgtggggataagtgacgtaatttcgattgggttttgngttgtcgtgggggaccaaaggggacaaagtggtcaccgtctcttcagccctaccaccgaacgggcccagtcggtccttcccctcggccacccctccctccaacgacgccaccgtcgtcgggggccacgacgccggccccgtggggccttcggcccgttcgggttacccgaaacggggttacccgttacccgtttacccaacccgttaaggttcggaccggaaccgttcgggtaacgggttcccgggggtccgg

SEQ ID NO: 329548 - DNA, 578 bp, Homo sapiens
  misc_feature: GZ8MTXP01A4JPW.39.34.D01.1.454.CMB.2.raw
  modified_base (370)..(370): a, c, t, g, unknown or other
  misc_feature (370)..(370): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatgtaattcagtagactgaagtccaacgacacggccgtgtacttctgtgcgagaggcagagttccacgtgggggataagtgacgtaatttcgattgggttttgntgtcgtggggaccaaggggacaaagtggtcacgtctcttcagcctaccaccaacgggcccatcgtccttcccctcggccacccctcctccaacgacgccaccgtcgtcgggggccacgacggccggcccgtggggccttcggcccgttcgggtccgaaacgggttaccttacttcccaactacggtcgcgacttggaacggcggggcg

SEQ ID NO: 329549 - DNA, 542 bp, Homo sapiens
  misc_feature: GZ8MTXP01DYHOV.39.34.D01.1.454.CMB.2.raw
  modified_base (200)..(200): a, c, t, g, unknown or other
  misc_feature (200)..(200): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccaggggaaanagccaccctctcctgcagggccagtcagaaaattagagcactattagcctggtaccagcaaaactgcagctccagctctcattatggtgcgtccagcagggccacgtggcatcccagacaggttcagtggcagtgggtcctggggacagacttcaactctcgacgatcgacagactcggacccaacagtattttgcttgtagttattactgtacaacactacggacttcccgacggggcgtgtccggttcggaccaagggaccaagggtaggaagtccgaaacgactggtaacggcttgccacgatcttcgttcttcaatcttccgctattcctgaacttgg

SEQ ID NO: 329550 - DNA, 549 bp, Homo sapiens
  misc_feature: GZ8MTXP01CWWTN.39.34.D01.1.454.CMB.2.raw
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatgaaattcagtagactgaaagtccaacgacacggccgtgtacttctgtgcgagaggcagagttccacgtggggataagtgcgaatttcgatggtttgntgtctggggccaaggggacaagtggtcacgtctcttcagcctcaccaacgggcccagtcgtcttcccctggccgaccctcctccaacgacgccacctcgtcgggggcacgacgccggccctggggcttcggccttggtcaagggaccttcgttccaacgtagtcgcgacttcggaacgcgggcg

SEQ ID NO: 329551 - DNA, 624 bp, Homo sapiens
  misc_feature: GZ8MTXP01CT70I.39.34.D01.1.454.CMB.2.raw
  modified_base (259)..(259): a, c, t, g, unknown or other
  misc_feature (259)..(259): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatcaaaacngcctacatggaattcagtagactgaagtccaaacgacacggccgtgtacttctgtgcgagaggcagagttccacgtggggataagtgacgtaatttcgaattgggttttgaagttgtcgtaggggacccaaaggggactaaagtcgggtactaccgtctcttcacgccctaccacccgaacggggccccaacgttccgggtcccttcccccgttcgggccctacccccgtccctaccaacgacgccacccgtcgtacgggggccaccgacgcccggcccgttggggccttcggcccgttcgggtaccgaagggttaccgttacttcccaacttacggtcgcggacgttgtaacgggcgggtccgg

SEQ ID NO: 329552 - DNA, 613 bp, Homo sapiens
  misc_feature: GZ8MTXP01ACU86.39.34.D01.1.454.CMB.2.raw
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagttccacgtggggactaaggtgacgtaatttcgaaagttgggttttgagtgtcgtggggccaaggggactaagtggtcaccggtctcttcacgtccctaccgaccgaaacgggcccctacgtccgggtccttcccccgtcggggccctaaccccgtccctaccgaacgacgtccaccgtcgtcgggggccaccgacggcccgggcccgtgggaccgtcgcccgtgggtccgaaacgggttccttaccttcccgacgtaacgtcgccggacgtcggaacgggtccggg

SEQ ID NO: 329553 - DNA, 548 bp, Homo sapiens
  misc_feature: GZ8MTXP01A5Q6M.39.34.D01.1.454.CMB.2.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (449)..(449): a, c, t, g, unknown or other
  misc_feature (449)..(449): n is a, c, g, or t
  modified_base (542)..(542): a, c, t, g, unknown or other
  misc_feature (542)..(542): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacanggaattcagtagactgaagtccaacgacacggccgtgtacttctgtgcgagaggcagagttccacgtgggggataaggtgacgtaatttcgaattggttttgatggtcgtgggggaccaaggggacaatggtcaccggtctcttcagcctccaccaacgggcccagtccggtcttccccgnggggccacccgtcctccaagcgcaccgtcgtggggcacgcgcggccctggggctcgccgtggtcaacggccttactccaactgtcgcgactgnggtcgg

SEQ ID NO: 329554 - DNA, 614 bp, Homo sapiens
  misc_feature: GZ8MTXP01DS2Z6.39.34.D01.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccgaggggaaanagcccaccctctcctgcagggccagtcaagaaaattaagagcacctattagcctggtaccagacaaaactgcagcnccagctctnattanggtncgtcagcagggccactggcatcccagacaggttcagtggcaggtgggtcctgggacagacttcaactctcacgatcgacagacgtcggaaccccaanagtatttgcttgtagttattactgtaccaaacacgtaacggacttaccccgaaccggggtcgtcggcccgtttaccggaccgaaacggggacccgaaagggttacggaaacgtacccgaaaccggtaacctggtcggacttcggaccttaccgtattccttagttccttaccgtaacttcccgttaaccccgctacgttacctaacggttaaaccttaaggg

SEQ ID NO: 329555 - DNA, 566 bp, Homo sapiens
  misc_feature: GZ8MTXP01BYNGH.39.34.D01.1.454.CMB.2.raw
  modified_base (261)..(261): a, c, t, g, unknown or other
  misc_feature (261)..(261): n is a, c, g, or t
  modified_base (368)..(368): a, c, t, g, unknown or other
  misc_feature (368)..(368): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatggaattcagtagactgaaagtccaaacgacacggccgtgtacttctgtgcgagaggcagagttccagtggggataagtgcgtaatttcgattgggtttngtgtcgtggggaccaagggacaagtcggtcaccgtctctcacgcctaccaccgaacggcccagtccgtccttccccgtcggcctaccctcctaccaacgacgccaccgtcgtcggggcacgacgccggcccgtgggcttgccgttcggtacgaacggttaccttcttccaactgtcgtcgacgttggaacggcgggcg

SEQ ID NO: 329556 - DNA, 636 bp, Homo sapiens
  misc_feature: GZ8MTXP01EH9DC.39.34.D01.1.454.CMB.2.raw
  modified_base (260)..(260): a, c, t, g, unknown or other
  misc_feature (260)..(260): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatacaaaacngcctacatggaattcagtagactgaagtaccaacgacacggccgtgtacttctgtgcgagaggcagacgttccacgtggggaactaaggtgacgtaatttcgaaagttgggttttgagttggtcgtgggggaccaaaggggactaagtggtacaccgttctcttcacgtccctaccgaaccgacgggcccacgtccggttcccttcccccgtcggggccctaccccgtccctaccgaacgccgcccaccgtcggtcgggggtccaaccggacgcccgggtcccgtcgggccgtcggttcccgtacgggtaccaaacgggttaccttaccgttaacccgacgttaacggtcgccggttacgtcgggaacggccgggg

SEQ ID NO: 329557 - DNA, 583 bp, Homo sapiens
  misc_feature: GZ8MTXP01ASEYE.39.34.D01.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatcaaaacngcctacanggaattcagtagactgaagtccaacgacacggccgtgtacttctgtgcgagaggcagagttccacgtgggactagtgcgtaatttcgaattggtttgatgtcgtggggaccaagggacaagtgtcaccgtctcttcacgccctccaccgaacgggcccagtccggtccttcccccgtcggggccctacccctccctacccaacgacgccaccgtcggtcgggggccacgacggccggcccgtggggcctcggccgtgggtaccaacgggttccttaccgttcccacgtaacggtcgcggacgtggaacggccgggg

SEQ ID NO: 329558 - DNA, 593 bp, Homo sapiens
  misc_feature: GZ8MTXP01DUAK2.39.34.D01.1.454.CMB.2.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacaacaaaatatgcacagagatttcgagggcaggtcaccatgactcgggacacgtccatacaaaacngcctacanaggaattcagtagactagaagtccaacgacacggccgtgtacttctgtgcgagagcagtacgtccagtggggataaggtgacgtaatttcgaaagttgggttttgagttgtcggtggggaccgaagggactaagtcgtacaccgttctcttcacgccctaccaccgaacgggccctagtccggttcccttcccccgtggggcccctaccctcctacccgaagccgcacccgtgtcggggccacgcgcccggcctgggcctcgccgtggtacaacggttccttccgtaaccacgttaacgcgacgttacgtcggaacggtccgg

SEQ ID NO: 329559 - DNA, 658 bp, Homo sapiens
  misc_feature: GZ8MTXP01EU8EU.39.34.D01.1.454.CMB.2.raw
  modified_base (261)..(261): a, c, t, g, unknown or other
  misc_feature (261)..(261): n is a, c, g, or t
  modified_base (385)..(385): a, c, t, g, unknown or other
  misc_feature (385)..(385): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngacctacatggaattcaagtagactagaaacgtccaaacgtacacggccgtagtacttctgtgacgagaggcaggtacgttccgacgtggggataacggtgacgtaatttcgagttgggtttgngtgtacgtggggaccaaggggacagtcggactaccgtctcttcgacgccctacccgaaccgaacgggccccaagttcccggttcccttcccccgtcggtaccccgtacccctcccgtacccgaacgaccgcctacccgtcggtcgggggacctaccggacggtcccgggcccgtcggggtcttcgggccttacgggtaccgtaaacgggttaccctttaccgttcccgtaacgtcggtaacgcggtaccgttgggaaccggcggggtaaccgg

SEQ ID NO: 329560 - DNA, 660 bp, Homo sapiens
  misc_feature: GZ8MTXP01AIA8X.39.34.D01.1.454.CMB.2.raw
  modified_base (261)..(261): a, c, t, g, unknown or other
  misc_feature (261)..(261): n is a, c, g, or t
  modified_base (365)..(365): a, c, t, g, unknown or other
  misc_feature (365)..(365): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatggaattcagtagactgaagtccaacgacacggccgtgtactctgtgcgagaggcagagtccagtggggatagtgacgtaatttcgattgggtttgntggtcgtggggccaaggggacagtcggtcacgtctctcacgcctaccaccgaacgggcccacgttccggtcccttacccccgtcgggaccctaaccccgttcccgttacccgaaacggaccgcccgtaacccgtccggttaccggggggaccctaaccggtaccggccccgggtccccggtcgggggtcccgttcgggtcccgttcggttaccggaaacgggttccctttacccgttaccccgtaaccgttacggttcggccggtaaccgttcgggaacggccgggggtaaccgg

SEQ ID NO: 329561 - DNA, 686 bp, Homo sapiens
  misc_feature: GZ8MTXP01BQS4N.39.34.D01.1.454.CMB.2.raw
  modified_base (262)..(262): a, c, t, g, unknown or other
  misc_feature (262)..(262): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcgagggcagggtcaccatgactcgggacacgtccatacaaaacngcctacataggaattcaagtagactagaacgtccaacgacacggccgtgtacttctgtgcgagagcagacgttccagtggggaactaaggtgacgtaatttcgaagttggttttgattggtcgtgggggtaccaaaggggactaagtcggtactaccgtctcttcacgtcccctaccgaaccgaacgggccctacgttcccggttacccttccccccgtcgggggacccctaccccgtaccctacccgaaacgaccgtcccgaacccgttcggtccggggggtaccaaccggaccggtcccggggtccccgtggggttcccgtcggttcccgttacgggtaccgttaaacgggttcccttaacccgttaaccgtaaccgttaacggttcggaccggttaacccgttgggaacgggtcccggggg

SEQ ID NO: 329562 - DNA, 620 bp, Homo sapiens
  misc_feature: GZ8MTXP01DNTU5.39.34.D01.1.454.CMB.2.raw
  modified_base (261)..(261): a, c, t, g, unknown or other
  misc_feature (261)..(261): n is a, c, g, or t
  modified_base (315)..(315): a, c, t, g, unknown or other
  misc_feature (315)..(315): n is a, c, g, or t
  modified_base (370)..(370): a, c, t, g, unknown or other
  misc_feature (370)..(370): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatggaattcagtagactagaagtccaaacgacacggccgtgtacttcngtgcgagaggcagagttccacgtggggataagtgacgtaatttcgattggttttngtgtcgtggggaccaagggacaagtcgtcaccgtctcttcacgccctaccaaccgacgggcccacgttccgtccttcccccgtcggaccctacccctcctacccgaaacgacgccctacccgtcggtacgggggcctaccgacggcccggcccgttcggggcttcggccccgttgggtaacctaacgggttacccttaccgttacccgaacgttaaggtccgcggtaccgttggaacggccggggtccgg

SEQ ID NO: 329563 - DNA, 569 bp, Homo sapiens
  misc_feature: GZ8MTXP01CWF9M.39.34.D01.1.454.CMB.2.raw
  modified_base (455)..(455): a, c, t, g, unknown or other
  misc_feature (455)..(455): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacagcctacatggaattcagtagactgaacgtccaacgacacggccgtgtacttctgtgcgagaggcagacgttccagtggggaactaaggtgacgtaaatttcgaaagttgggttttgagttgtcgtggggaccaagggacaagtggtcaccgtctcttcacgcctccacaacgggcccagtccgtccttccccgnggggccctacccgtcctccaacgcgccaccgtcgtcggggcacgacggccggcccgtgggctcgccgtggtcaacggttccttacgtccactgtcgcgacgtcggaaggccggg

SEQ ID NO: 329564 - DNA, 615 bp, Homo sapiens
  misc_feature: GZ8MTXP01CVMXZ.39.34.D01.1.454.CMB.2.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (385)..(385): a, c, t, g, unknown or other
  misc_feature (385)..(385): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctccagatacgaccggagaaattgtgttgacgcagagtccaggcaccctgtctttgtctccgaggggaaagagccaccctctcctgcagggccagtcaagaaaattaagagcactatagcctggtacagacaaaactgcagctccagctctcattangtncgtcagcagggccactggcactcccagacaggttcagtggcaggtgggtctggggacagacttcaactctcacgatacgacagactcggaacccanagtatttgcttgtagtattactgtacaacactaacggactccgacggggtcgtcggccggttacggaccgaaacggggaccgtaaaggtacgggaaacgtaccgaaaccggtaacgtgggtaacgggtccttacgggaccttaacccgtaacttccgttacgtttcccgttacctaacgttcccctttccccgaccttaacgttccgtaacggttaaaccgtttaacggg

SEQ ID NO: 329565 - DNA, 651 bp, Homo sapiens
  misc_feature: GZ8MTXP01D4C94.39.34.D01.1.454.CMB.2.raw
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacagcctacatggaattcagtagactgagtccaacgacacggcgtgtacttctgtgcgagaggcagacgttccgacgtggggaactaaggtgacgtaatttcgaagttggttttgagttggtcgtgggggacctaaagggggactaaagttcgggtctacccggttctccgtttacacgtaccctaccgaacccgtaacggggcccctacgtccggttacccctttccccccgtcgggggacccctaccccgttacccctaccgaaacgaccgtccgaacccgtccgtcgggggccacgacgggccggcccgtcgggctcggttccgtcggtaccgaacggttccttaaccgtccctaacgttaagtcggcgttacgtcggaacggtccgggg

SEQ ID NO: 329566 - DNA, 566 bp, Homo sapiens
  misc_feature: GZ8MTXP01EX7IQ.39.34.D01.1.454.CMB.2.raw
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaacagcctacatggaatcagtagactgaacgtaccacgacacggccgtgtacttctgtgcgagaggcagagtccacgtggggataaacgtgtagtaatttcgtagttaggttttgnttggtcgtggggaccaagggacaagtggtctacgtctcttncgccctccacgacggcccatccgtcctccccncgccnccctcctccacgacgccacctcgtcgggggcacacggccggcccgtgggcttcggccgttggtaccgaacggttacgttccttcgaacgttagtcgcgattcggaaggttcgggcg

SEQ ID NO: 329567 - DNA, 561 bp, Homo sapiens
  misc_feature: GZ8MTXP01A8XL2.39.34.D01.1.454.CMB.2.raw
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (506)..(506): a, c, t, g, unknown or other
  misc_feature (506)..(506): n is a, c, g, or t
  modified_base (544)..(544): a, c, t, g, unknown or other
  misc_feature (544)..(544): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccgaggggaaangcccaccctctcctgcagggccagtcaagaaaattaagagcactactagcctggtaccagacaaaacngcagcncngcnctnattangtnctcagcaggcagtgcactccagacaggttcaggtggcgtaggtgggtccgtggggacagtacttcaactctcacgactcgacacgactacggaacccaacgtagtattttgcttagtgttaacttactgtacaactacgtacggactaccgacggggtcgtcgtcccggtcggaccgaagggaccgaagggtacgaacgtcgaaaccgacgtggnggcttagcaccgtatcttgttcttcaacttccgtcccnctattctaacgaacgtg

SEQ ID NO: 329568 - DNA, 646 bp, Homo sapiens
  misc_feature: GZ8MTXP01CXLHL.39.34.D01.1.454.CMB.2.raw
  modified_base (269)..(269): a, c, t, g, unknown or other
  misc_feature (269)..(269): n is a, c, g, or t
  modified_base (377)..(377): a, c, t, g, unknown or other
  misc_feature (377)..(377): n is a, c, g, or t
  modified_base (444)..(444): a, c, t, g, unknown or other
  misc_feature (444)..(444): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatccaaccccgagagtggcgacaacaaaatatgacacagagtatttcgagggcagggtcaccatcgacgtcgggacacgtccaatacaaaacncgacctaacataggaattcgaagtaagactagaaacgtacccaaacgaccgaccggccgttgtactttcgtgtgcgaggaggcagtacgttccaggtggggaataggngtcgtaattcgtaaagtttggtttgagttcggtcggtacggggaccgaaagggtactaagtcgtacnccgttactcttcacgccctaccgacgacggcctacgtccggtacccttcccccgcggggtaccccaccccgttaccacccgaacgacccgccgtaaccgtccggtcgggggcccacggccggcccgggcccgtcgggcgtccgccgtacggtaccaacggttccttacctccgtacgtaacgtcggcgacgtggcggtcggg

SEQ ID NO: 329569 - DNA, 662 bp, Homo sapiens
  misc_feature: GZ8MTXP01A3Y21.39.34.D01.1.454.CMB.2.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacaacaaaatatgcacagagtatttcgagggcagggtcaccatgacgtcgggacacgtccatacaaaacngaccanagaggaattcaagtagactagaacgtaccaacgacgacggccgttagtaccttcgtgtgacgagagcagtacgttacacgtgggaataggtgacgtaatttcgaagttggtttgagtggtcgaggggtaccaaggggtactaagtcggtaccaccggttctacgttcgactacccctaccgaacccgacgggtacccctagttcccggttacccctttcccccgacggggtccccttaaaccccgttcccgaaccgaaacggtccggccctaaccgtttccggggacgggggacccaccgacgggcccggcccgttgggcctccggcccgttagggacaacgggttccttaccttaacgacgtaagtcgaccgttagtcgaacggtcccgg

SEQ ID NO: 329570 - DNA, 631 bp, Homo sapiens
  misc_feature: GZ8MTXP01BWC60.39.34.D01.1.454.CMB.2.raw
  modified_base (260)..(260): a, c, t, g, unknown or other
  misc_feature (260)..(260): n is a, c, g, or t
  modified_base (373)..(373): a, c, t, g, unknown or other
  misc_feature (373)..(373): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtcatacaaaacngcctacatggaattcagtagactagaaacgtccaaacgacacggccgtgtacttctgtgcgagaggcagacgttccagtggggataaggtgacgtaatttctagttggtttgngttgtcgtggggaccaaggggacaagtcggtacctaccgtctcttcacgccctacccgaaccgaacgggccccagttcccgggtaccccttcccccgtcggcccctaccccttccctaccgaacgaccgccctaccgtcggtacgggggccaccgacggcccgggcccgtcggggccttcggcccgttgggtaccgaacgggttacccttacgttcccaagttacggtcgccggtacgttcggaacgggccgggtcgg

SEQ ID NO: 329571 - DNA, 572 bp, Homo sapiens
  misc_feature: GZ8MTXP01EJ4YY.39.34.D01.1.454.CMB.2.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctanatggaattcagtagactgaaacgtccaaacgacacggccgtgtacttctgtgcgagaggcagagttccagtggggataagngacgtaatttcgattgggtttgntgtcgtggggaccaaaggggacaagtcgtcaccgtctctcacgcctaccaccgaacggcccacgtccgtccttccccgtcggcccaccctcctaccaacgacgccaccgtcgtcgggggcacgacggccggcccgtgggcttcggccgttggtacgaacggaccttcgttccaactagtcgcgacgttcggaacgcgggtcg

SEQ ID NO: 329572 - DNA, 608 bp, Homo sapiens
  misc_feature: GZ8MTXP01COPY9.39.34.D01.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccgaggggaaanagcccaccctctcctgcagggccagtcaagaaattagancactatagctgacanacaaacngcagctccagctctctattatggtcgcgtcagcgacgggccacgtcggacactcccagacgtaggttcaggtcggcaggtcggtccgngggacagtacttcaacttctcgacgtactcgaactacgacgtacggaacccaagtagtattttgcttgtagttattacgtagtaaccaagtaaccgtacggacgtcccgaacggggtcgtcggtaccgttccggaacgtaacggaaccgtaagggtacggtaacgtaccgaaaccgtgtcggtcggacttcggaccaccgtagtccttgttcttccgaacttcccgttcccgactacgttacgtaacgttaacgtcgg

SEQ ID NO: 329573 - DNA, 616 bp, Homo sapiens
  misc_feature: GZ8MTXP01BV9XC.39.34.D01.1.454.CMB.2.raw
  modified_base (375)..(375): a, c, t, g, unknown or other
  misc_feature (375)..(375): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacagcctacatggaattcagtagactgaagtccaacgacacggccgtgtacttctgtgcgtagagcagagttaccacgtaggggataacgtgacgtaagtttcgagtttgggtttgngttggtcgtcggggaccaaggggacaagtcggtactaccgtctacttcacgcctacccaccgaacgggcccacgttccgtccttacccctcggccaccccttccgtaccaacgacgccgaccgtcgtcgggggctacgacggccggcccgtgggccttcggcccgttcggtacgtaacgggttaccttaccttcccgaacttacggtcggtacgacgttacggtaacgggcgggtaaccgg

SEQ ID NO: 329574 - DNA, 568 bp, Homo sapiens
  misc_feature: GZ8MTXP01BFERP.39.34.D01.1.454.CMB.2.raw
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (367)..(368): a, c, t, g, unknown or other
  misc_feature (367)..(368): n is a, c, g, or t
  modified_base (561)..(561): a, c, t, g, unknown or other
  misc_feature (561)..(561): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaaatatgcacagagatttcagggcagggtcaccatgactcgggacacgtccatcaaaaacagccctaanatgaatcagtagactgaataccaacgacacggccgtntacttctgtgcgagagcagagttccagtggggataacgtgacgtaatttcgattggtttnntgtcgtggggacaaagggacaagtcggtcacgtctctcacgccctaccgaacgaacgggcccagtccggtcccttcccccgtcggaccctacccctcccgtaccaaacgacgcctaccgtcgtcggggcacgacgccggcccgtggcttcgccgttggtacaacggcttaccttccaatagtcgcgacttcgnggcggcg

SEQ ID NO: 329575 - DNA, 648 bp, Homo sapiens
  misc_feature: GZ8MTXP01AQLAG.39.34.D01.1.454.CMB.2.raw
  modified_base (300)..(300): a, c, t, g, unknown or other
  misc_feature (300)..(300): n is a, c, g, or t
  modified_base (351)..(351): a, c, t, g, unknown or other
  misc_feature (351)..(351): n is a, c, g, or t
tcagtcgcactagtcacgaccggtgctcgatttagatcgtctgtgttgggtttgggggagctgctcagttaggacccagacggaaccatggaagccccagcgcagcttctcttcctcctgctactctggctcccagatatcactggagaaatagtgatgacgcagtctccagcccaccctatctgtgtctccaggagaaagcgccaccctctcctgtagggccagtcagagtgttagcagctaacttagcctggtaccagcagaacctggccaggtcccaggctcatcatctagtggtcncatcccacgacgggccacgtggtactccccagtccctaaccccgtttaggnggctagggttcggggtctgggggaactagggtacgttccacctcctacaccgtatacagaccacgcctggctagtctagtaacgttatttgacgttagtttacttacgttacggtacaaactaacgtaactaacgttacgtaaccgttcggtcccttccgttaccgtaccggtttccggggaaccggggtaacgggacccggtaaacggggttagggaaacggtaacgttaaaccgaaaaccggttaccgtaagggtacggtccgttcggaccttaacccgtaacgttccgtttccg

SEQ ID NO: 329576 - DNA, 630 bp, Homo sapiens
  misc_feature: GZ8MTXP01AQ71F.39.34.D01.1.454.CMB.2.raw
  modified_base (214)..(214): a, c, t, g, unknown or other
  misc_feature (214)..(214): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacaganatttcagggcagggtcaccatgactcgggacacgtccatcaaaacagcctacatggaattcagtagactgaagtccaacgacacggccgtgtactctgtgcgagaggcagagttccagtggggatagtgcgtaatttcgattgggttttgaatggtcgtggggccaaaggggacaagtcggtcaccgtctcttcacgccctccaaccgaacgggccccaagttccggtcccttcccccgtcggccctaccccttcccgtaccaacggaccgccgacccgtcgtacgggggccaccggacgcccgggccccgtcggggccttcggccccgttagggtaccgtaaacggggttaccttaccgttcccgaaccgttaggtcggccggtaacggttcggtaacgggccggggtaaccggg

SEQ ID NO: 329577 - DNA, 598 bp, Homo sapiens
  misc_feature: GZ8MTXP01ECJSH.39.34.D01.1.454.CMB.2.raw
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatggaattcagtagactagaacgtccaaacgacaacggccgtgtacttctgtgcgagaggcagagttccagtggggataacgngacgtaatttcgattgggtttgaatggtcgtggggacctaaaggggacaagtggtcctacgtctcttcacgccctaccaccgtaacgggcccagtccggtcccttcccccgtggccctacccctcctaccgaacgacgccaccgtcgtcgggggcaccgacggccggcccgtggggcttcgcccgttggtaccgaacggttaccttacgttcccaacgtcgtcgcgtacgttcggaacggttcgggcg

SEQ ID NO: 329578 - DNA, 619 bp, Homo sapiens
  misc_feature: GZ8MTXP01BAQ93.39.34.D01.1.454.CMB.2.raw
  modified_base (262)..(262): a, c, t, g, unknown or other
  misc_feature (262)..(262): n is a, c, g, or t
  modified_base (412)..(412): a, c, t, g, unknown or other
  misc_feature (412)..(412): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccaatacaaaacngcctacatggaattcagtagactgaagtccaacgacacggccgtagtacttgtgtgcgagaggcagtacgttccagtgggataaggtgcgtaatttcgaattggttttgattgtcgtggggaccaaggggacaaagtcggtacacccgtntccttcgacgtccctcgaaccgaacgggccccagtcccggttaccttcccccgtggggccctacccctccctaccgaaacgcgaccctaacccgtcgtcgggggccaccgacggtccgggccccgtggggcctcggcccgtagggtacccaacgggttccttaccgttcccgacgttaacgtcggcgttacgtcggaacggccgggg

SEQ ID NO: 329579 - DNA, 704 bp, Homo sapiens
  misc_feature: GZ8MTXP01AWQLH.39.34.D01.1.454.CMB.2.raw
  modified_base (207)..(207): a, c, t, g, unknown or other
  misc_feature (207)..(207): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatccaaccccgagagtggcgacaacaaaatntgacacagagtatttcgagggcgaggtccaccatgacgtcgggacacgtccaatacaaaacncgacctaacanaggtaattcaagtagactagaacgtaccaacgaccgaccggtcgtcgtacttacgtggtcgacggtagtacggacgagtacgttaccgacggtaggggtaacttaggtcgtacgttaagtttcggtaagtttcgggttttgagtcgggtacggtacgggggtaccgaaagggtactaagtcggtacaccggttctcgtacgcgaccctccgaaccggaaccgggtccctacgttcccggtcccctttacccccggcggggtacccctaccccgttccacccggaaacgcccgccctaaccggttcgggacggggcccaacggtcccgggcccggcccggttggccctcggacccgtacgggtaacaacgggttccctttacggaacctacgggttcgcggtcggttacgtcggaacgggtccgg

SEQ ID NO: 329580 - DNA, 703 bp, Homo sapiens
  misc_feature: GZ8MTXP01B5NVG.39.34.D01.1.454.CMB.2.raw
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagtatttcgagggcagggtcaccatgactcgggacacgtccatacaaaacngcctacatggaattcagtanactagaacgtccaacgacacggccgtagtacttctgtgcgagaggcagtacgttccacgtggggaactaaggtgagtatttcgaattgggttttgngttggtcgtcggggtaccgaaaggggactaagtcggtctaccgttctcgttcacgcccctaccgaaccgtaacgggccctacgttcccggtaccctttccccccgtcggggtacccctaccccgttccccttacccgaaacggccgtacccgtaacccggtttcggggacgggggtaccccaccggtaaccgggccccggggtccccggttcgggggccctttccgggccccgttaacggggttacccgaaacgggttccccttaaccgtttcccgaaacgtttcggtggacccggttaaccgtcggggaaccgtcccgggggg

SEQ ID NO: 329581 - DNA, 738 bp, Homo sapiens
  misc_feature: GZ8MTXP01B1F1K.39.34.D01.1.454.CMB.2.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatntgcacagagattcagggcagggtcaccatgactcgggacacgtcatacaaaacngcctanatggaattcagtagactgaactccaacgacacggccgtgtacttntgtgcgagaggcagtacgtcacggtgggataagtgacgtaatttcgagttgggtttgaagttggtacgttggggacccaaggggactagtcgggttactaccgttctacttccgacgtcccgttaccccgaaccggtaaacgggtccccctaacggttcccggttcccccgtttcccccgtcgggtacccccttaaccccccgttccgttaaccccgaaaggttaacccgccccgtaaccccgtttcccggggtacggggggcccaaaccggggtccggcccccgggggtcctccggggggtccttacgggccccggtttacggggttacccgaaaacggggttcccttaacccggttacccgtaaacggtttccgggaacccggttcgggaacccggttggggtaacccggggttccgggggtcccgg

SEQ ID NO: 329582 - DNA, 662 bp, Homo sapiens
  misc_feature: GZ8MTXP01B188V.39.34.D01.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (499)..(499): a, c, t, g, unknown or other
  misc_feature (499)..(499): n is a, c, g, or t
tcagtcgcactagtcacgaccggtgctcgatttagatcgtctgtgttgggtttgaggtgaagaagcctgggacctcagtgaaggtcccctgccaggcttctggatacatcttcagcgcctattatatacactgggtgcgccaggccccctggacaagggcctgagtggatgggatgtatccaaccccgagagtggcgacaacaaaatatgcaacagagatttcgagggcagggtcaccatgactcgggacacgtccaatacaaaacngacctacatggtaaattcaagtagactagaacgtaccaacgacacggccgtntactntgtgacgagaggcagtcgttccagtggggtaactaaggtgacgtaatttcggtaaattgggttttgacgttgggtcggtacggggaccgaaaggggacctaaagtcgggtcaccgttctcgttacacgtccccgtaccaccggtacggcccctacgtcccggtcccttcccccgnggggtaccccaccccggttccaccgaaacggcccgacccgtcccgtcgggtcggggaccacgccggcccggtcccgtggggcctcgggcgttacgggacttaaccgggttcttacccgttcccgaaaggttcgacggacccgttagtcgggaacgggtcccgg

SEQ ID NO: 329583 - DNA, 651 bp, Homo sapiens
  misc_feature: GZ8MTXP01EDWW5.39.34.D01.1.454.CMB.2.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccgaggggaaanagccacctctccngcagggccagtcaagaaaattagagcacctatagcctggtaccagacaaaactggcaggctcccaggctctcatttatggtgcgtcagcaggggccacgtggcactccagactaggttcagtggcagtggtctgggacagtacttcaaaccttctcacgtactacgactaggactacgggaccctaacgagtaatttcgcttgttagttaacttacgttgtaccaaactacgtaacggatccccgaaccgggggtcgttacggccggtttaccggaccgaaacggggaaccgtaaggggttaacgaacgtaccgtaaaccgtaacgtgggttaacgggcttggacccttaaccgtacgttacgttcggtttccttcccgtaacgtttccccttaaccccggtcctacttacccgttaacggttaaaccgtttcgggg

SEQ ID NO: 329584 - DNA, 830 bp, Homo sapiens
  misc_feature: GZ8MTXP01D98B8.39.34.D01.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtgcgacaacaaaatatgcacagagtatttcgagggcagggtcaccatgacgtcgggacacgtcaatacaaacncgcctanataggaattcgagtagactagaacgtccaaacgacaccggtccgtagtacttccgtggtcgacggaggacggcacggtacgttaccgaacggttaggggaacttaaggtcggtacgttaacgtttacggtagtttcgggttttagcggttcgggttacgggtacgggggtaaccgtaaacggggtaactaaacgggttcggtaccctaccgttaccgtttcgtaccgacgtacccccttaacccggaaccccggtaaacggggtcccccttaacgttcccccggggttaccccctttcccccccggtacgggtaaccccccgttaacccccccgttacccgttaaaaccgggaaacccggttacccgacccccggttaaaccccggtttcgggggggaaccccggggtaaccctaaacccggggccccggtacccccgggggtttccgggtaaccgggtacccgttccgggtacccggttacggtaaaccggtaacccgttaccgttccttaccgtaacggttaggccgtacccgaggttcggcggggttcccggtaagg

SEQ ID NO: 329585 - DNA, 759 bp, Homo sapiens
  misc_feature: GZ8MTXP01B0BRM.39.34.D01.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtgatggatgtatcaacccgagagtgcgacaacaaaatntgacacagagtatttcgaggcaggtcaccatgacgtcggacacgtccatacaaaacngacctacataggaattcaagtanacgtagaacgtaccaacgaccaccggtccgttagtaccttgtaggtggacggaaggacggtactaggtacgtttacccgaacggtagggggtaaattaacgggtgtaaccggttaaattttcggtaaagtttgggtttttaagacgtttcgggtaccgggtacgggggtaacccgtaaaggggactaaagtcgggtacctaacccggttctcttaccgacgtacccctaccgaacccgtaacgggtcccctaacggtcccgttccccttccccccgaggggtaccccctaccccgttacccgaaccgtaaacggcccgtacccgtaacccggtttcggggccgggggtacccaaacgggtcccgggccccgggttcccgtgggggcccttcgggcccgtttaacgggaaccgttaaaccggttaccctttaccggtaacacgttaacggcgaccgttacggtcggaacgggtccggg

SEQ ID NO: 329586 - DNA, 679 bp, Homo sapiens
  misc_feature: GZ8MTXP01AT97P.39.34.D01.1.454.CMB.2.raw
  modified_base (273)..(273): a, c, t, g, unknown or other
  misc_feature (273)..(273): n is a, c, g, or t
  modified_base (620)..(620): a, c, t, g, unknown or other
  misc_feature (620)..(620): n is a, c, g, or t
  modified_base (628)..(628): a, c, t, g, unknown or other
  misc_feature (628)..(628): n is a, c, g, or t
  modified_base (665)..(665): a, c, t, g, unknown or other
  misc_feature (665)..(665): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccacggcccctggacaagggcctgagtggagtgggatgtactccgaacccgagagtggcgaacaacaaaatatgcacagagatttcgagggcgaggtaccaccatcgacgtcgggacacgtaccatacaaaacngacctacacgtaggaactcgtagtagtactagaacgtacccaacgaccgacggccgtagtaccttcgtgtcggacgtacggaggcgtaggtacgttaccgtaggtacgggtaataaggtacggtacgttaacgttcgttaaaggtttgggttttgaggttcggtcgggtacggggaccgtaaagggacaaagttccggactaccggttcttccgttccacgccccgtaccccaaccggaacgggcccctacgtacccgggttccctcccccggttggggacccctacccgtccctaccgaaacgcgtcccgaccggttgccgggtaccacgtacggcccggttcggngactcggngtacggtacgaggttcccttacttccaagtgtcgcgnggtaacgcggtcgg

SEQ ID NO: 329587 - DNA, 564 bp, Homo sapiens
  misc_feature: GZ8MTXP02GDFA5.39.34.D01.1.454.CMB.2.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatacaaaacagcctacatggaaattcagtagactgaagtccaaacgacacggccgtgtacttctgtgcgagaggcagagttccacgtggggataagtgcgaatttcgattggttttgatgtcgtgggggaccaaaggggacaagtgggtacaccgttctcttcacgcctccaccaacgggcccagtccggtccttcccccgtggcccacccctcctcccaacgacgccaccgtcgtcgggggcacgacgccggcccgtgggcctgccctgggtcaacggactacttccaacgtagtcgacgacgcgacgcggcg

SEQ ID NO: 329588 - DNA, 564 bp, Homo sapiens
  misc_feature: GZ8MTXP02IJQZ6.39.34.D01.1.454.CMB.2.raw
  modified_base (431)..(431): a, c, t, g, unknown or other
  misc_feature (431)..(431): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacatgtccatcaaaacagcctacatggaattcagtagactgaagtccaacgacacggccgtgtacttctgtgcgagagcagagtccacgtggggataagtgacgaatttcgatggtttgatgtctggggccaagggacaatggtcaccgtctcttcagcctccaccaagggcccatccggtcttccccnggcccaccctcctacccaagtacgccacctcgtcgggggcacgacggccggacccgtgggcctcggcccgttgggtacctaaacgggaccttaaccgttccaacgttacgtacgccgtaaccgttgaacgggg

SEQ ID NO: 329589 - DNA, 584 bp, Homo sapiens
  misc_feature: GZ8MTXP02GT752.39.34.D01.1.454.CMB.2.raw
  modified_base (199)..(199): a, c, t, g, unknown or other
  misc_feature (199)..(199): n is a, c, g, or t
tcagtcgcactagtcacgaccggtgctcgatttagatcgtctgtgttgggtttggggagctgctcagttaggacccagagggaaccatggaaaccccagcgcagcttctcttcctcctgctactctggctcccagatacgaccggagaaattgtgttgacgcagagtccaggcaccctgtctttgtctccaggggaaanagccaccctctcctgcagggccagtcagaaattagagcacctacttagcctggtaccagcaaaacctggccaggctcccaggctcctcatttatggtgcgtccagcagggccacgtggcatcccagacaggttcagtgcagtggtcctgggacagacttcactctcacgatcgacagactcggaacccaacagtatttgcttgtgttattactgttacaaacactacggatcccgaccggtcgtgcccgttcggaccctaagggacccgaaagggtcggaaacgtaccaaacccggtaactacggtcgggcctagaccgaacccattaccgtcgtacctttcaacttcccgtttaccccgcctaacttcctacggaaacttacgg

SEQ ID NO: 329590 - DNA, 537 bp, Homo sapiens
  misc_feature: GZ8MTXP02G2DOS.39.34.D01.1.454.CMB.2.raw
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagttccacgtggggataagtgcgaatttcgattggtttgatgtcgtggggccaaggggacaaatggtacaccggtctcttcagtcctccacacgggcccatccgtccttccccctggccacccgtcctccaagacgcacctcgtcggggacacgagccggcccgtgggctcgcctggtccaaggcctacttccactagtcgcgactgagcggg

SEQ ID NO: 329591 - DNA, 519 bp, Homo sapiens
  misc_feature: GZ8MTXP02F1B4F.39.34.D01.1.454.CMB.2.raw
  modified_base (395)..(395): a, c, t, g, unknown or other
  misc_feature (395)..(395): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagtccactggggataagtgcgaatttcgattggtttgatgtctggggccaaggggacaatggtcaccgtntctcagcctcacaaggcccatcgtctcccctggccaccctcctccaagacgcacctcgtacggggcacgagcggccctgggctcgcctggtcaaggctacgtccactagtcgcgactgagcggg

SEQ ID NO: 329592 - DNA, 590 bp, Homo sapiens
  misc_feature: GZ8MTXP02HKQ1X.39.34.D01.1.454.CMB.2.raw
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggttccgtgtacttctgtgcgagaggcagagttccactggggataagtgcgaatttcgattggtttgattgtcgtgggggccaaggggacaagtggtcaccgtctcttcagcctccaccaacgggcccatccggtccttcccccgtcggccctacccctcctccaacgacgccacccgtcgtcgggggccacgacgccggcccgtcggggcctcggcccgtgggtccgaaacgggtacccttacctttaacccgacgttaacggtcgaccggtaccgtcggacggcccgggg

SEQ ID NO: 329593 - DNA, 584 bp, Homo sapiens
  misc_feature: GZ8MTXP02IZQV0.39.34.D01.1.454.CMB.2.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccaggggaaanagccaccctctcctgcagggccagtcagaaattaagagcacctattagcctggtaccagcaaaacctggccaggctccaggctcctcatttanggtgcgtccagcagggccactggcatcccagacnggttcagtgcagtggtctgggacagacttnactctcacgatcgacagactggacccaanagtatttgactgtgtattactgtacaacactacggacttcccgaaccggcgttagcccggtttcgggacccgaaaggggacccaaaggggtcggaaaacggttccgaaaccggaacgttcggtacgggctaggccaacccgattccgtcgtctttccaacgttcccttacccgcctaattcctaggtaacctttacgg

SEQ ID NO: 329594 - DNA, 524 bp, Homo sapiens
  misc_feature: GZ8MTXP02I0GQB.39.34.D01.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (391)..(391): a, c, t, g, unknown or other
  misc_feature (391)..(391): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccaggggaaanagccaccctntcctgcagggccagtcagaaaattagagcacctacttagcctggtaccagacaaaacctggccaggctcccaggctcctcatttatggtgcgtccagcaggggccactggcatcccagacaggttcagtgcaggtggtctgggacagacttcactctcacgatcgacagactggacccaanagtatttgctgtgtattactgtcaacactacggatccacggcgtagcccgttcggaccaagggaccaaggtgaaacgtcaaccgatgtacggctgcacgatctgtcttcaactccttccgcatctagaactag

SEQ ID NO: 329595 - DNA, 571 bp, Homo sapiens
  misc_feature: GZ8MTXP02JTI9F.39.34.D01.1.454.CMB.2.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtcatcaaaacngcctacatggaattcagtagactgaagtccaagacacggccgtgtacttcngtgcgagacggcagacgttccgacgtggggactagtgcgtaatttcgattgggtttnattggtcgtggggacaagggacaagtgtcaccgtctctcgacgcctaccacgaacggcccacgtccggtccttccccgtcggccctaccctcctaccgaagcgaccaccgtcgtcggggcacgacgccggtccgtgggctcggccgtacggtaccgaacggtacctaccgtccgaacgtacgtcgacgacgtcggacggtcggg

SEQ ID NO: 329596 - DNA, 529 bp, Homo sapiens
  misc_feature: GZ8MTXP02HPFJT.39.34.D01.1.454.CMB.2.raw
  modified_base (259)..(259): a, c, t, g, unknown or other
  misc_feature (259)..(259): n is a, c, g, or t
  modified_base (520)..(520): a, c, t, g, unknown or other
  misc_feature (520)..(520): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcggacacgtccatcaaaacngcctacatggaaattcagtagactgaagtccaaacgacacggccgtgtacttctgtgcgagaggcagagttccactggggataagtgcgaatttcgatggtttgatgtctggggccaaaggggcaaatgtcaccgtctcttcacgcctccaccaacggcccacgtcgcttccccctcggccaccctcctccaacgagcacctctgggggcacgagcgcccgtgggctgcctggtcaacggactactccaactagcgcgacncgcgcggcg

SEQ ID NO: 329597 - DNA, 559 bp, Homo sapiens
  misc_feature: GZ8MTXP02HHCSP.39.34.D01.1.454.CMB.2.raw
  modified_base (369)..(369): a, c, t, g, unknown or other
  misc_feature (369)..(369): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaaacgacacggccgtgtacttctgtgcgagaggcagagttccagtggggataagtgacgtaatttcgagttggttttgngttgtcgtgggggaccaaggggacaagtggtcaccgtctctcagccctaccaccgaacgggcccacgtccggtccttcccccgtcggcccacccctcctaccacgacgccaccgtcgtcgggggcacgacgcggcccgtcggctgcctggcacggactactaccaacgtacgtcgcgacgtgacgcggcg

SEQ ID NO: 329598 - DNA, 579 bp, Homo sapiens
  misc_feature: GZ8MTXP02JZ60A.39.34.D01.1.454.CMB.2.raw
  modified_base (341)..(341): a, c, t, g, unknown or other
  misc_feature (341)..(341): n is a, c, g, or t
  modified_base (509)..(509): a, c, t, g, unknown or other
  misc_feature (509)..(509): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacagcctacatggaattcagtagactagaagtccaacgacacggccgtgtactctgtgcgagagcagagtccagtgggatagngacgtattcgagttggtttgatgtcgtggggacctaagggacagtggtcaccgtctctcagccctacaccgaacggcccagtccgtcccttcccctggccaccctcctaccgaacgacgcccaccgttcgcgggggaccaccggtacgcccgggtcccgtcggggccnccggtccgtcggtacgtaaaccggtaccttaaccttccgaacgttacgcgtacgacgtggacggtccggg

SEQ ID NO: 329599 - DNA, 535 bp, Homo sapiens
  misc_feature: GZ8MTXP02IUFUT.39.34.D01.1.454.CMB.2.raw
  modified_base (436)..(436): a, c, t, g, unknown or other
  misc_feature (436)..(436): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcggacacgtccatcaaaacagcctacatggaattcagtagactgaagtccaacgacacggccgtgtacttctgtgcgagaggcagagttccatggggataagtgcgaatttcgatggtttgatgtcgtggggccaagggacatgtcaccgtcgtctcagcctccaccaacgggccacgtcgtccttcccctcggccnccctccctccaagacgccacctcgtacgggggcacgacgcggcccgtggcctcgccgtcggtccacggactactccgactacgtcgcgactgacgcggg

SEQ ID NO: 329600 - DNA, 619 bp, Homo sapiens
  misc_feature: GZ8MTXP02JHMSS.39.34.D01.1.454.CMB.2.raw
  modified_base (260)..(260): a, c, t, g, unknown or other
  misc_feature (260)..(260): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatggaattcagtagactagaagtccaacgacacggccgtgtacttctgtgcgagaggcagagttccacgtggggaactaagtgacgtaaatttcgagttggttttgattggtcgtgggggaccaaggggacaagtcggtcaccggtctcttcgacgccctccaccgaacgggcccacgtccggttccttcccccgtggccctaccccgtccctaccgaaacgaccgcctaccgtcgtcgggggaccacgacggcccggtcccgtcggggccgtcggcccgttacgggtaccgaaacgggtacccttaccgtccgaacgttaacggtcgaccgtacggtacggacggtcccggg

SEQ ID NO: 329601 - DNA, 583 bp, Homo sapiens
  misc_feature: GZ8MTXP02FUV3H.39.34.D01.1.454.CMB.2.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaaacgacacggccgtgtacttctgtgcgagaggcagacgttccagtggggataagtgcgtaaatttcgattggtttgagtgtcgtgggggaccaaaggggacaaagtggtcaccgtctctcagcctccaccaacgggcccagtccggtccttcccccgtcggccacccctcctacccaaagacgccaccgtcgtcgggggccacgacgccggcccgtcgggcctcggccgtggtaccgaacggtacctacgttacccaacgtacgtcggaccgtacgtcggacggtcggacgg

SEQ ID NO: 329602 - DNA, 593 bp, Homo sapiens
  misc_feature: GZ8MTXP02JCJ24.39.34.D01.1.454.CMB.2.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagacgttccacgtggggataagtgacgtaatttcgattggtttgattggtacgtgggggaccaaagggggacaaagtcggtctaccgtctcttcacgccctaccaccgaacgggcccacgtccgtccttcccccgtcggcccaccccgtcctacccaacgacgccaccgtcgtcgggggcacgacgccggcccgtcgggcctcggccgtcgggtaccaacgggtacctaccgttaccaacgttacggtcgacgacgtggacggtcgggcg

SEQ ID NO: 329603 - DNA, 576 bp, Homo sapiens
  misc_feature: GZ8MTXP02H6LR2.39.34.D01.1.454.CMB.2.raw
tcagtcgcactagtcacgaccggtgctcgatttagatcgtctgtgttgggtttgaggtgaagaagcctggggcctcagtgaaggtccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagttccacgtggggataagtgacgaatttcgattggttttgattgtcgtggggccaaggggacaatgtcaccgtctcttcagcctccacgaacgggcccagtccggtcccttcccccgtcggccctaccccgttccctaccaacgacgccaccgtcgtcgggggccacgacggccggcccgtcggggcctcggcccgtgggttaccgaacggtacctaccgttccacgtacgtcgacgactcggacgccgggg

SEQ ID NO: 329604 - DNA, 568 bp, Homo sapiens
  misc_feature: GZ8MTXP02I1WMX.39.34.D01.1.454.CMB.2.raw
  modified_base (260)..(260): a, c, t, g, unknown or other
  misc_feature (260)..(260): n is a, c, g, or t
  modified_base (370)..(370): a, c, t, g, unknown or other
  misc_feature (370)..(370): n is a, c, g, or t
  modified_base (450)..(450): a, c, t, g, unknown or other
  misc_feature (450)..(450): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatggaattcagtagactagaacgtccaaacgacacggccgtgtacttctgtgcgagagcagagttccacgtggggataacgtgacgtaatttcgattggtttgngtgtcgtggggaccaagggacagtggtcaccgtctctcacgtccctccaccgaacgggcccagtccggtccttcccccgnggccctacccctcctaccaagcgccaccgtcgtcggggcacgacgccggccctgggctgcccgtggacacggtacctaccttaccaacgtacgtcgaccgtacgtcggacggcggtcg

SEQ ID NO: 329605 - DNA, 602 bp, Homo sapiens
  misc_feature: GZ8MTXP02IO4F7.39.34.D01.1.454.CMB.2.raw
  modified_base (421)..(421): a, c, t, g, unknown or other
  misc_feature (421)..(421): n is a, c, g, or t
  modified_base (585)..(585): a, c, t, g, unknown or other
  misc_feature (585)..(585): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccgaggggaaagacgccaccctctcctgcagggccagtcaagaaaattaagagcacctacttagcctggtaccagacaaaacctggccaggctccagctcctcatttatggtgcgtccagcgacgggccacgtggccactccccagactaggttcaggtcggcgtaggtggtccgtggggacaggtaccttcaccgttctcgacgactccgacacgacgtacggacccaagngtatttgcttgttgtattactgtacaactacgtacgactcccgacggtcgtcgtacccgttcgggacccgaacggggtaccgaagggtcgaaacgtaccgaaaccgtacgtggtacggcgtacgacctaccattccgtacgtcttcgtaacttcccgttacccnctatcctagaaccttgg

SEQ ID NO: 329606 - DNA, 600 bp, Homo sapiens
  misc_feature: GZ8MTXP02IQAYC.39.34.D01.1.454.CMB.2.raw
  modified_base (188)..(188): a, c, t, g, unknown or other
  misc_feature (188)..(188): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattacatccactgggtgcgccaggcccctggtcaagggcctgagtgggtgggctccatcaaccccaanactggcgacacaaactctgcacagaactttcagggcagggtcaccatcgacccgggacacgtcatcaatacagcctacatggaactcagtagacgtaaaatccgtagacgacaccggcctctattacngtgngagaggacagagttccagtggggatagngcgntatttacgatgtctttgatatcgtggggaccaaggggactaagtcgtacaccgttctcttcacgccctaccgaaccgaccggccctagtcccggttacccttcccccgacggtcccctacccctcccgtaccaacgtccgaccaccgtcgcgggggccacgacgccggccgtcgggccgtcggccgttacggacgtaacggtaccttacgtccgacggttacgcggaccgtacgtcggacggtccggg

SEQ ID NO: 329607 - DNA, 611 bp, Homo sapiens
  misc_feature: GZ8MTXP02JQ10O.39.34.D01.1.454.CMB.2.raw
  modified_base (261)..(261): a, c, t, g, unknown or other
  misc_feature (261)..(261): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatggaattcagtagactgaagtccaacgacacggccgtgtacttctgtgcgagaggcagagttccagtggggatagtgcgtaatttcgagttggtttgatgtcgtggggaccaaggggacaagtcgtacaccgtctcttcacgtccctacccgaacgtaaccggggcccctagttcccggttccccgtttccccccgtgggtcccctaaccccctcccttacccgaaaacgccgacctacccgttcggcgggggaccaccgacggccggtcccgtgggccttcggcctcgggtacaacggtcctacgtccaacgtacggtcgccgtaacgtggacggtccgggg

SEQ ID NO: 329608 - DNA, 560 bp, Homo sapiens
  misc_feature: GZ8MTXP02IPH7L.39.34.D01.1.454.CMB.2.raw
  modified_base (211)..(211): a, c, t, g, unknown or other
  misc_feature (211)..(211): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtcttttgtctccaggggaaagagccaccctntcctgcagggccagtcagaaaattaagagcacctacttagcctggtaccagcaaaacctgccaggctcccagctcctcatttatggtgcgtccagcaggggccacgtggcatccccgagacaggttcaggtgcagtgggtcctgggacagacttcactctcacgatcgacacgactcggacccaacagtattttgcttgtgttattctgtactaaacacgtacggactcccgacggcgtcgccgttcggaccgaagggaccaaggtcggaaacgtcgaaaccgaactggtacggctcggactaccagttctacgtcttcaacttcctcccgactactactgtaactcgg

SEQ ID NO: 329609 - DNA, 589 bp, Homo sapiens
  misc_feature: GZ8MTXP02JHZGS.39.34.D01.1.454.CMB.2.raw
  modified_base (260)..(260): a, c, t, g, unknown or other
  misc_feature (260)..(260): n is a, c, g, or t
  modified_base (320)..(320): a, c, t, g, unknown or other
  misc_feature (320)..(320): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatggaattcagtagactgaagtccaacgacacggccgtgtacttctgtgcgagnggcagagttccacgtggggataagtgacgtaatttcgattggtttgattgtcgtgggggcctaagggacaagtcgtacaccgtctctcacgcctccaccgaacggcccacgtccgtccttcccccgtcggcccacccctccctaccaacgacgccaccgtccgtcgggggccacgacggcccggcccgtcgggccgtcggccgtcgggtaccgaacgggtaccttaccgtccgtaaccgtacggttcgacgtacgtcggacggccgggg

SEQ ID NO: 329610 - DNA, 571 bp, Homo sapiens
  misc_feature: GZ8MTXP02FFMAQ.39.34.D01.1.454.CMB.2.raw
  modified_base (259)..(259): a, c, t, g, unknown or other
  misc_feature (259)..(259): n is a, c, g, or t
  modified_base (472)..(472): a, c, t, g, unknown or other
  misc_feature (472)..(472): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatcaaaacngcctacatggaaattcagtagactgaacgtccaaacgacacggccgtgtacttctgtgcgagaggcagtacgttccagtggggataaggtgacgtaatttcgattggttttgatgtcgtggggaccaagggacaagtgtacaccgtctcttcagccctccaccgaacggccctatccggtccttcccccgtggccacccctcctaccaagacnccaccgtcgtcgggggcacgacggccgcccgtcgggctcggccgtggtaccgaacggtacctaccgttccaacgtacgtcgacgactggacggcggtcg

SEQ ID NO: 329611 - DNA, 823 bp, Homo sapiens
  misc_feature: GZ8MTXP02IBXDH.39.34.D01.1.454.CMB.2.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacngcctacatggaattcagtanactgaagtaccaacgacacggccgtgtacttctgtgcgagagcagagttccagtggggataagtgacgtaatttcgattggttttgattggtcgtgggggacccaaaagggggtacaaagttcgggtacctaacccggttcttaccgtttcgaacggtcccccttaccccgaaacccggaaacgggggtaccccccaacggtttccccggggttaccccctttacccccccccgtttggggacccccctaaccccccttttacccccgtaacccccgtaaaacgggtacccggacccctaaacccccgtttccgggggtacccgggggggtaacccctaaccgggtaacccggggtacccccgggggacccccccgtttggggggaccccttttccggggaacccccgtttttcgggggtaaaccccgaaaaacgggggttacccccgttttaaaaccccttttacccccgaaacccggttttaagggtccggaaccccgggtaaaccgtttaccgggggacgggtaccccgggggtacccgg

SEQ ID NO: 329612 - DNA, 639 bp, Homo sapiens
  misc_feature: GZ8MTXP02F3H7P.39.34.D01.1.454.CMB.2.raw
  modified_base (261)..(261): a, c, t, g, unknown or other
  misc_feature (261)..(261): n is a, c, g, or t
  modified_base (384)..(384): a, c, t, g, unknown or other
  misc_feature (384)..(384): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgacgtcggacacgtccatacaaaacngcctacatggaattcagtagactagaacgtccaaacgaccacggccgtgtacttctgtgacgaggacgcgtaggtacgttccgacgtaggggaataaggtgacgtaaatttcgattggtttgngtgtcggtaggggaccgaaagggacaaagtcgggtactaccgttctcttacacgtccctacccgaaccgaacgggcccctagtccggtccccttcccccgcggacccctacccccgtctacccgaaacgtccgacccgtaccgtcggtacgggggaccacgacggtcccgacccgttgggccttcggcgttacggacctaaacgggtaccctacgttacccaacgttacggcgacgtacgtggacggccggacgg

SEQ ID NO: 329613 - DNA, 631 bp, Homo sapiens
  misc_feature: GZ8MTXP02I3QPP.39.34.D01.1.454.CMB.2.raw
  modified_base (322)..(322): a, c, t, g, unknown or other
  misc_feature (322)..(322): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaacccgagagtggcgacacaaaatatgcacagagatttcagggcagggtcaccatgactcgggacacgtccatacaaaacagacctacataggaattcagtagactgaagtccaacgacacggccgtgtacttctgtgcgagnggcagacgttccagtggggaataggtgacgtaatttcgaagttgggttttgagttggtcgtgggggaccgaaaggggacaagtcgggtaccacccggttctacttcgacgtccctaccaccgaacgggccccagtcccggttccttcccccgtggacccacccctcctacccgaagaccgccacccgttcggcgggggccacgacggcccggtcccgtggggcctcggtcccggttacggtacccgaaacgggtacccttaaccgttcccgaacgttacggtcggaccgacgttacggacggcccgggg

SEQ ID NO: 329614 - DNA, 647 bp, Homo sapiens
  misc_feature: GZ8MTXP02I48LJ.39.34.D01.1.454.CMB.2.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcggacacgtccatcaaaacagcctacatggaaattcaagtanactagaacgtccaaacgacacggccgtgtactctgtgcgagagcagtagtcagtagggataacgtagacgtaattcgtagttggtttgngtgtcgtggggacgaagggactagtggtaccaccgtcttctcacggccctaccgaccgaacgggcccctaataccgacgttccccttccccccgtagggtcccctaccccctcccttaccgaaacgaaccggccctaacccgttcggcgggggacccaacgaccggcccgggtccccggtcggggcccttcggtacccgttcgggtaccgaaaacggtcccttaacccgtttccgaaaacgttcggtaccgcggtaaccgtcggaacggcccggggg

SEQ ID NO: 329615 - DNA, 638 bp, Homo sapiens
  misc_feature: GZ8MTXP02GV6EG.39.34.D01.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagtattcgagggcagggtcaccatgacgtcggacacgtcatacaaaacngcctanatagaattcagtanactagaacgtaccaacgacgacggtcgtgtactcgtgtgacgagaggcagtacgtaccagtagggaataagtgacgttaattcgtagttggtttgngttggtacgnggggacgaagggactaagtcggtaccaccgttctccttcgacgtccctaccgaacccgaacgggtcccctagttcccggttccccttacccccgcggacccctaaccccgtccctaccgaaacgcccgaccaacccgtcgggtcggggaccaacccggacgggtcccgcccggtgggtccctcgtacccgtggtaccaacggtacccttaccgtaccaagtcgtacggacgagtccggagggtccggtacg

SEQ ID NO: 329616 - DNA, 607 bp, Homo sapiens
  misc_feature: GZ8MTXP02H959I.39.34.D01.1.454.CMB.2.raw
  modified_base (199)..(199): a, c, t, g, unknown or other
  misc_feature (199)..(199): n is a, c, g, or t
  modified_base (317)..(317): a, c, t, g, unknown or other
  misc_feature (317)..(317): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccaggggaanagccaccctctcctgcagggccagtcaagaaattagagcactactagcctggtaccagacaaaactggccaggctcccaggctcctctattatggtgcgtccagcagggccactggcntccccagacaggttcagtggcaggtggtcctggggacagacttcactctcacgatccgacagactacgacccaacagtattttgctgtgttattactgtacaactactacggactcccgacggtcgtgcccgttcgggacctaacggggaccaagggtacggaacgttaccgaaaccgtaacgtcggtcggaccttcggaccctaccgtacttccgttcgtttacccttacgtaacctttcccgttacccccggtactaaccgtttccgtaacggttaaaccgttacggg

SEQ ID NO: 329617 - DNA, 670 bp, Homo sapiens
  misc_feature: GZ8MTXP02IO534.39.34.D01.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggaaaattgtgttgacgcagagtccaggcaccctgtctttgtctccaggggaaanagccaccctctcctgcagggccagtcagaaaattaagagcactattagcctggtaccagacaaaactggccaggctccaggctccncatttanggtncgtcagcaggccactggcatcccagacagttcagtgcaggtggtctggggacagacttcgactctcacgatcgactagactacggaacccaaacgagtattttgactgtacgttattactcgtacaaactaccgtacggacttacccgaaccgggcgttacggtcccggttacgggaccgtaaacggggacccgtaaaggggttcggaaaacgttaccgaaaacccggtaacgttcggtaacgggtccttacgggacccaaaccctaaacggttccctttacgggttcccttttaacccgaactttaaccccgtttccccccggacctttaacggttacccctttaacggaaaacccgttttaaggtcccgggg

SEQ ID NO: 329618 - DNA, 862 bp, Homo sapiens
  misc_feature: GZ8MTXP02H762E.39.34.D01.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgctcgaggggaaanagccacctctcctgcagggccagtcaagaaattagancacctatagcctggtaccagacaaaaccgtggccaggcctcccgaggctcctctattagtggtgccgtccagcgacggggccacgtcggaccactaccccgagacgtacggtttacaggtcgggaccgtaggggtcggggtcccgttacggggacctaacggtacctttaccgaccgttacccttaccgaaccggtaacgttacccggaaacgtaacggtaaccgtacggggaaaccccctaaaacgtagttaacgtttttcggaccgtttaggttacgttttaaacgttttaaccggttaacgtttaaaacccgtaaccgttaaaccgggtaaccgtttacccccgggaaacccgggggttacccggtttaccggggttcccccgggttttaacccgggggaaacccccgggttaaaaccgggggaaaccccgggttaaacgggggttaaccggggaaaaccggtttaacccgaaaaccccggggtaaaccgtttggggtaacccgggtccgttacggaacccctaaccgtaacgtttcccgttacggtttaccctttaccgtaacctttccccgttacccccggtacctaacgttacccgtaccggtaacgtttaacggtccgg

SEQ ID NO: 329619 - DNA, 615 bp, Homo sapiens
  misc_feature: GZ8MTXP02HVVG9.39.34.D01.1.454.CMB.2.raw
  modified_base (262)..(262): a, c, t, g, unknown or other
  misc_feature (262)..(262): n is a, c, g, or t
  modified_base (321)..(321): a, c, t, g, unknown or other
  misc_feature (321)..(321): n is a, c, g, or t
  modified_base (459)..(459): a, c, t, g, unknown or other
  misc_feature (459)..(459): n is a, c, g, or t
  modified_base (510)..(510): a, c, t, g, unknown or other
  misc_feature (510)..(510): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagtatttcgagggcagggtcaccatgactcgggacacgtccatcaaaacngacctacatggaattcaagtagactggaaactccaaacgacacggccgtgtacttctgngcgagaggcagactccgagtggggatagtgacgtaatttcgatttggtttgatgtcgtcggggaccaaggggacaagttcggactacgtcttactcacgtccctccaccgtaacgggcccagtccgtccttcccccgngtcccacccctcgtacccaagccgtacgacccgttgcggggtcccaaccgnggcccggcccccgtggggtccttacggcccgttggggtacctaacgggtacccttccgtaccgaaccgtttaggtccgacccgtaagttcggaacggtccggtcg

SEQ ID NO: 329620 - DNA, 644 bp, Homo sapiens
  misc_feature: GZ8MTXP02IEI1O.39.34.D01.1.454.CMB.2.raw
  modified_base (262)..(262): a, c, t, g, unknown or other
  misc_feature (262)..(262): n is a, c, g, or t
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcgagggcagggtcaccatgacgtcggacacgtccatacaaaacngcctacataggaattcagtagactagaacgtaccaacgacacggtccgtgtacttctgtgcgagaggcagtacgttccacggtaggggaataggtgacgtatttcgagtttggtttgagttggtccggtaggggaccgaagggactaagtcgtccaccggttctcgtcacgcccctaccgaacgaacggtcccacgttcccgtacccttcccccgtaggccccctccccgttacccaccgtaaaccgcgacccgtacccgtcgggtaccgggggcctaaccggacgggcccccgtccgggtcggcccttcggcccgttacggacgaaaccggtacccttaccgtcccgtacgtacggtccgacgtaccgtcggacggccggg

SEQ ID NO: 329621 - DNA, 662 bp, Homo sapiens
  misc_feature: GZ8MTXP02H67NT.39.34.D01.1.454.CMB.2.raw
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
tcagtcgcactagtcacgaccggtgctcgatttagatcgtctgtgttgggtttgaggtgaagaagcctggggcctcagtgaaggtccctgccaggcttctggatacatcttcagcgcctattatatacactgggtgcgccaggcccctggacaagggcctgagtggatgggatgtatccaacccgagagtggcgacacaaaatatgcacagagatttcgagggcagggtcaccatgacgtcggacacgtccatacaaaacngctacatagaattcagtacgactgaacgtccaacgacacggccgtgtacttcgtgtgcgagacgnagacgttccgacgtggggactaaggtgacgtaagtttcgagttggttttgagttgtcggtaggggaccgaaggggactaagtacgtcgaccgttctctcgacgtccctaccgaccgtaaccgggacccgtaccgtccggttccccttcccccgttacccgggtaccctacccctacccctaccgaaccgacgacccgtacccggttcggcgggggtaccaaccgtcgggaccccgggtccggtccgggtccgtcggtccggtacggttaccgaaacggttacctaccggttaaccctacggtacgttaccggacgaccgttcggaacggtccgggg

SEQ ID NO: 329622 - DNA, 631 bp, Homo sapiens
  misc_feature: GZ8MTXP02JQVBT.39.34.D01.1.454.CMB.2.raw
  modified_base (261)..(261): a, c, t, g, unknown or other
  misc_feature (261)..(261): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
tcagtcgcactagtcacgaccggtgctcgatttagatcgtctgtgttgggtttgggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccagtacaaaacngacctacatggaattcagtagactagaacgtccaaacgacacggccgtgtactctgtgcgagngcagactccacgtgggatacgtgacgtatttcgattggtttgngtgtacgtggggaccaagggacaagttcgaccgaccgttctctacgacgtaccctacacccgaacggccctaagtcccggtacccctttcccccgnggccctaacccccgttccgtacccgaaggaaccgccctaacccgttccgggtacgggggccaacggcgccccggtccgtcgggccttcggaccccggttggaaccgaacggtacccttaccgttaccaacgttacggtacgaccggacgtacggacggccggggtacg

SEQ ID NO: 329623 - DNA, 546 bp, Homo sapiens
  misc_feature: GZ8MTXP02IAK63.39.34.D01.1.454.CMB.2.raw
  modified_base (265)..(265): a, c, t, g, unknown or other
  misc_feature (265)..(265): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
tcagtcgcactagtcacgaccggtgctcgatttagatcgtctgtgttgggtttggaggtgaagaagcctggggcctcagtgaaggtccctgccaggcttctcggatacatcttcagcgcctattatatacactgggtgcgccaggcccctggacaagggcctgagtggatgggatgtatccaacccgagagtggcgacgacaaaatatgcacagagatttcgagggcagggtcaccatgacgtcgggacacgtccagtcaaaacngcctacatggaattcagtagactgaagtccgaagacaacggccgtcgtacgttccgtaggtcgcgagaggcaggagttccagtggggaactaagtgcgtaattcgatggtttgntgtctgggcctaagggcaatggcacgtacnctcagcctccacgaggccancgtctccccngcacctctcaagcgcaccgtgtcggggcacgacgcggtcccgtgggcctacgggtccctgggttacaaacgggtcctacgtccgaacgtcgtcgcgactgacgtcgg

SEQ ID NO: 329624 - DNA, 606 bp, Homo sapiens
  misc_feature: GZ8MTXP02IWFPQ.39.34.D01.1.454.CMB.2.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctcccagatacgaccggagaaattgtgttgacgcagagtccaggcaccctgtctttgtctccaggggaaanagccaccctctcctgcagggccagtcaagaaaattaagagcacctacttagcctggtacagacaaaacctggcaggctccagctcctcattntgtgctcagcagggccactggcatccccagacgnggttcaggtgcaggtgggtcctacggggacagtacgttcaccttcnctacgatccgacagacacgggtacccaaacgtaggtacttttgacttgtgttaattaccgtgtacctaaacgtactacgggtactcccgaaccggggtcgttacggtccccgggttcggacccgaaagggggtaccaaggggtggtaaacgtcgaaacccgtagtacggtgggcttacggactacacgtctcgttcttacgccttaccgtcccgtactagttcacgtaaacttg

SEQ ID NO: 329625 - DNA, 625 bp, Homo sapiens
  misc_feature: GZ8MTXP02IU50X.39.34.D01.1.454.CMB.2.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (328)..(328): a, c, t, g, unknown or other
  misc_feature (328)..(328): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagaggtggcgacaacaaaatatgcaacgagagtatttcgagggcagggtcacatgactcgggacacgtcatacaaacnacctanatggaattcagtanactagaacgtaccaaacgacaccggtccgtagtacttgtgtcgngagaggcagtacgtccagtaggggatagngacgtattcgattggtttngtcggtgacggggtaccgaagggtanaagttcggacctacgtctcttcgactcccgtaccaccgaacggtccctacgtccggttcccttccccgacggtcccctaccccgttcctaacgacgtaaccgcccgtaccgtccggtaggggacccaaggccggcccgccggtcggaccctcgggtacccgtaggaccgtaacggtaccttacctaccgaacgttagcgtaccgagtcggacggtcggtacgg

SEQ ID NO: 329626 - DNA, 568 bp, Homo sapiens
  misc_feature: GZ8MTXP02F8Y69.39.34.D01.1.454.CMB.2.raw
  modified_base (272)..(272): a, c, t, g, unknown or other
  misc_feature (272)..(272): n is a, c, g, or t
  modified_base (412)..(412): a, c, t, g, unknown or other
  misc_feature (412)..(412): n is a, c, g, or t
  modified_base (486)..(486): a, c, t, g, unknown or other
  misc_feature (486)..(486): n is a, c, g, or t
  modified_base (541)..(541): a, c, t, g, unknown or other
  misc_feature (541)..(541): n is a, c, g, or t
tcagtcgcactagtcacgaccggtgctcgatttagatcgtctgtgttgggtttgggggagctgctcagttaggacccagagggaaccatggaaaccccagcgcagcttctcttcctcctgctactctggctccagatacgaccggagaaattgtgttgacgcagagtccaggcaccctgtctttgtctccgaggggaaagagcccaccctctcctgcagggccagtcaagaaaattaagagcacctacttagcctggtaccagacaaaaccnggccaggctcccaggctcctcattatggtcgcgtccagcgacgggccacgtggccagtccccaagacgtacggttcgaggtggcaggtcgggtccgtagggacagacttcacttctcacgatcgacagactcgacccaangtatttgctgtgtatctgtacaagtacacgactccgacggcgtcggccgttacggacgaacgggactaaggggngaaacgtacgaaaccgtacgtgtacggctacgaccgacacgttctacgtcttacncgttcctcccgctactcgacgtactgg

SEQ ID NO: 329627 - DNA, 615 bp, Homo sapiens
  misc_feature: GZ8MTXP02HYVA2.39.34.D01.1.454.CMB.2.raw
  modified_base (261)..(261): a, c, t, g, unknown or other
  misc_feature (261)..(261): n is a, c, g, or t
  modified_base (462)..(462): a, c, t, g, unknown or other
  misc_feature (462)..(462): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacngcctacatagaattcagtagactgaacgtaccaacgacacggccgtgtacttactgtgcgagaggcagtagtccacgtggggaataacggtgacgtaatttcgtattaggttttgatgtcgtgggggacccaaaggggacaagtcggtccaccgttctctcgagaccctcaccgaaggcccctagtcgtcccttaccccgnggtaccaccccttcctacccaagtaccgcctaccgtcgtgggggacctacgacggccggcccgttcggggctacggcccgtaggtaccaacgggtaccttaccgttccgaaaccgtggttaacggcccgtacgacggtacggggacgggtccg

SEQ ID NO: 329628 - DNA, 594 bp, Homo sapiens
  misc_feature: GZ8MTXP01A210W.52.74.G08.1.454.CMB.2.raw
  modified_base (304)..(304): a, c, t, g, unknown or other
  misc_feature (304)..(304): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtgcctgggacagacggccacaattacctgcggggagacaatattgtggccagacatgtgcactggtatcagcagaagcaggccaggcccctgtcctggtcatctatagggatattaagcggccctntggaactccctgagcgattccactggcgccaaattcggacaacgcggtcccacccgtgacccatccgaagtacgaagccccgaaaggtccgggggaatggaaggctggacctactcgtgtcagggtgggtgggacgaggcggcacgtagtgtaacgtttcgggacgggtagggaccgtaaggttcggaacccgttccgtaaacgttccgaacggtccccaaaggggttcccttccggtcccccgtacgggttcccacttcccgttccgtttcccccggcccctttccccg

SEQ ID NO: 329629 - DNA, 658 bp, Homo sapiens
  misc_feature: GZ8MTXP01AERUQ.52.74.G08.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacgcacatacngcggggananatntgnacagacatgtncacgtgtatcgagcaagacgccgacggccgaccggtccctgtccgtgtacatcgtaagtaggtataacgtacggccgtcctacgtacggtaacctccgtagacgtcgtacttcccgacggtcggacccgacctaacgttaacccggaaccaacccgacccggtaccccaacccgtacgaacctaacgtacgtaacggtacgaaccgacccggtaagggtacggggtagtacggacggtacgtacgtaacgtaccgtcgtcgtacgtagggtcgggggtacgggacgacggacgtactacgtacgtacggttacggttcgggacgggtaacggtaccgtaaggtaacgaccgttacgtaacgcgaccgaccgacggttccgttcccggccccgtcggtcctccgtccgttacccgtccccttccgtccg

SEQ ID NO: 329630 - DNA, 616 bp, Homo sapiens
  misc_feature: GZ8MTXP01CWW9K.52.74.G08.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctctatgaactgactcagcctctctcagtgtcagtggccctgggacagacggccacaattaccnggcggggganacaatattgngaccagacatgtgcactggtatcagcagaagccaggccaggcccctgtcctggtcatctatagggatagttaagcggccctcgtggaactccctgagcgattccactggcgccaattccgggacaacgacggcccaccctgacccatcagtacgaagcccgaaggtcggggatggacggctgactacgtcgtgtcgagggtgggtggggacgaggcggactacgtagtggtaagttttccggggcgggtaacggggtaccgtaaggttaacggtacccggttaccgtaacggttccgaacggtccccgaacgggttccgttcccggtccccccgttccgggtccctaccgttcccgttaccggtttcccccgttaaccccgtttccccg

SEQ ID NO: 329631 - DNA, 681 bp, Homo sapiens
  misc_feature: GZ8MTXP01C29CS.52.74.G08.1.454.CMB.2.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggcctggacagacgccacatacnggcggganacaatattganacagacatgtgcatggatcagcagacgcaggccacgccctgtcgtgtcatctagtaggatagttaacgcggccctgtacggaactccgtagacgcgtattcccacgtcggcgacctaaagttacccgggaacaaccgacccggacctaaccccgtacgaacccataccgaacgtacgaaacgacccgaaagggtcgggataggaacggtctaggtactacgtcgtggtacgagggttcggggtaggggacgaggacgggactaacggtaagttcggttaacggtttcgggaccgggtaacgggtaaccgtaacggttaacggtaacccgttaaccgttaaacggttaccggaaccggaccccgttaaacggggttcccgttacccggtccccccgttaccggggttccccttaaccggttccccgtttcccggttaacccccgttaaccccgtttccccg

SEQ ID NO: 329632 - DNA, 655 bp, Homo sapiens
  misc_feature: GZ8MTXP01BZLJA.52.74.G08.1.454.CMB.2.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctctatgaactgactcagcctctctcagtgtcagtggccctgggacagacggccacaattaccnggcgggganacaatattgngaccagacatgtgcactggtatcagcagaagccgaggccacggcccctgtcctggtcatctagtagggatagttaacgcgtccctgtggaactcctagacgcgtattcccacgtggcgacctaacgttccgggaacctaaccgacccgggacccctaacccgtacggaaccctacgtacgaacggtacggaaacgaccccggtaaggggtaccgggggatacgggaacggtcgtacgtaccgttacgtcgtgtacggagggttcggggtacggggacgacggcggtactaacgtagtcggtaggtttcgggacgggtacgggacctaagggttcgtaacccgttacgtaacgcgaaccgaccgaacggttccgttacccggtccccgttcggtcctaccgtccgttaccgttccccttcccgttaaccc

SEQ ID NO: 329633 - DNA, 668 bp, Homo sapiens
  misc_feature: GZ8MTXP01D05Z3.52.74.G08.1.454.CMB.2.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcacttttacaggtttgtctggccttcctatgaactgactcagcctctctcagtgtcagtggccctgggacagacgcacattaccngcggggaacaatatgnaccagactatgtgcactggtatcagcaagaagccgaggccacggcccctgtcctggtcagtactaagtagggattaagttaacgccgggtacccttcgtaggtaaacttcccctaggacgcgtaactttccgaacgttcggaccgtacctaaacgttacccgggaaccaaaccgcccgggacccctaaaccccgttggaaacccctagttaacccgagttacggaaacgacccgtaaagggtacggggagtacggaacggtcgtagaccgtacgtcgtagtacgtagggttggggtagggacgacggacggactacgtacgtaggttacgtttcgggacgggtaacgggacgtaaggtcgtaaccgttacgtaacgttacgacgaccgacggttcgttccgtccccgtcgtcctacgtccttaccgttccccttaaccgttccc

SEQ ID NO: 329634 - DNA, 628 bp, Homo sapiens
  misc_feature: GZ8MTXP01AXAN0.52.74.G08.1.454.CMB.2.raw
  modified_base (137)..(137): a, c, t, g, unknown or other
  misc_feature (137)..(137): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (621)..(621): a, c, t, g, unknown or other
  misc_feature (621)..(621): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttntctggcctcctatgaactgactcagcctctctcagtgtcagtggccctgggacagacgcacattaccgggngggananatntganacaganatgnctacgtggtatcagacagacgccgacggccacggccctgtccgtgtactatcgtagtaggtaatagttacggccggtccctgtacggtactccgtgacgtcgtacttcccacgtcggcgtacctaacgtaccgaaccaacccgccggaccctacccgtacgacctacgtacgaacgtacgaacgacccgaagggtacgggtagtacggacggtctacgtacgtaccgtcgtaggtacggtagggtcgggggtacgggacgacggccggacgtacgtagtcggttacggttcgggacgggtacgggtacgtaacgggtcgtaccgttacgtacgacgacgtaccgacggccgttaccgtccccgtcgtcctccgtcgttaccgttccccncccgtcc

SEQ ID NO: 329635 - DNA, 563 bp, Homo sapiens
  misc_feature: GZ8MTXP02GB3O5.52.74.G08.1.454.CMB.2.raw
  modified_base (218)..(218): a, c, t, g, unknown or other
  misc_feature (218)..(218): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggccacaattacctggcggggganacaatattgtgaccagacatgtgcactggtatcagcagaagccaggccaggcccctgtcctggtcatctataggatattaagcggccctctggaactccctgagcgattccactggcncaatcggacaacncggccacctgaccatcagtgaagcccaagtcgggatgagctgactacgtacgtgtcgaggtggtagggacgaggacgggcaaccgtagtagtagttttcgggcggaacgggaaccgaaggttacggaccgtaccgtaacgtacgacgacccgaaacggccgtacgcccccgtccggtaccgtacctccgtaccgttcccctacccctttccccg

SEQ ID NO: 329636 - DNA, 556 bp, Homo sapiens
  misc_feature: GZ8MTXP02GCT8G.52.74.G08.1.454.CMB.2.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacgcacaattaccngcgggganacaatattgtgaccagacatgtgcactggtatcagcagaagccaggccaggcccctgtcctggtcatctagtaggatataagcggcctgtaggaactccctgacgcgtattcccactggcaccaattccggacaacgcgccacctcgaccatcagtcgaacgacccgaagtcgggatgagcgtagactacgtcgtgtcgaggtggtcgggacgaggcggacacgtagtgttacgtttacggcgggaacggaccgtaaggttacgaccgtaccgtaacgtcgaacggacccgaacggcctccgccccgtcggtccacgttccgtccgttccccacccttcccg

SEQ ID NO: 329637 - DNA, 668 bp, Homo sapiens
  misc_feature: GZ8MTXP02HRDMS.52.74.G08.1.454.CMB.2.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (643)..(643): a, c, t, g, unknown or other
  misc_feature (643)..(643): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacgcgacaatactcgngggagganaanattgtgacacanatagtgcactaggtagtacagacgacgaagaccacggaccgaccgtcccgtccgtcgtccgttcgactacctagtaaggaaggtattaaacgtacggcccgtccttaggaacgtacccttccgaggacgtacttaccgtacctacggcggaccaaacgtttacggccggaaccaaaccgggccctacccctaccgtacgaccactacgacgtaaacgacccgaaaccgtagggggtaggacgtagggacgtcgtaacgtaacctcgttcgtaccggtaggtagggttcgggaacgaacgcggggaccaacctaagttagaacggttttcggccgggaagggaaaccgaaacgttcggtaccgtacccgttaaactaggacaccgacgtacgtcgcccccgttaccggctacncctttcgtaccccggtttccccacc

SEQ ID NO: 329638 - DNA, 647 bp, Homo sapiens
  misc_feature: GZ8MTXP02FHX3Y.52.74.G08.1.454.CMB.2.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagcgcagtacgacacgaccggtgctcgatttagtagctctatcaggggctgggcctcaggaagcagcatcgggggtgccgcagccatggcctggaccgctctccttctgagccctccttgttcactttacaggttgtctggcctcctatgaactgactcagcctctctcagtgtcagtggccctgggacagacggccacaattacctggcggggganacaatattgngaccagacatgtgcagtggtatcagacagaacgccgacggccgacggcccctgtcctggtcatctagtaggataagtacggccgtcctcgtacggactcccgtgacgcgtattcccgacgtcggaccgacctaagttccggaacaaccgccggacccacccgtacgaaccatacgaagtacgaacgacccgaacgggtacggggagtaggacggcgtacgtactacgtacgtcgtacggtagggtggtacgggacgacggaccggactacgtagtaggttacgtttcggggacgggtaacgggtaccgtaacggtaccgtacccgtaccgtaacgtacgaaccggacccgaacggtcccgtacccggcccccgttcggtaccctaccgttcccgttcccggtcccccgtcccctcccg

SEQ ID NO: 329639 - DNA, 658 bp, Homo sapiens
  misc_feature: GZ8MTXP02G78LJ.52.74.G08.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggcanaattaccnggcggggaacaatatgngaccagacatgtgcactggtatcgagcagaagccaggcccacggcccctgtccctggtcatcgtagtaggattagtaacggccggtccctcgtaggaactcccgtagagcgtattcccacgtcggacactaagttccggaacaaccgcccggacccaacccgtagaacccatacgaacgtagaaccgacccgaaggtacggggagtacggacggcgtacgaacttacgtcggtcgttacggagggttgggtacgggacgacgggaccgggactaacgttagttacggttaacggttttcggggacgggtaacgggtaacgtaacggttaccggtaacccgttaccggtaaacgtaccgaaccgacccgaacggtccgtacccggtcccccgtccggtacctaccgtccgtcccgttcccccgtacccttccccg

SEQ ID NO: 329640 - DNA, 614 bp, Homo sapiens
  misc_feature: GZ8MTXP02H5GEP.52.74.G08.1.454.CMB.2.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggccaacaattaccgnggcggggganacaatattgtgaccagacatgtgcactggtatcagcaagaacgccaggccacggcccctgtcctggtcatctagtaggatatagcgtcctgngactccgngagctatccacgtgcactaattcggaacaacgccggcccacccgtgaacctatacaggtacgaacgacccgaagggtcggggaatggacggtcgtacgtaacctacgtcggtggtacgtagggtcgggtagggacgacgggacgggctaacgttagtacggttacggtttacggggacggggtaaggtaaccgtaaggtttcggaacccgttaccgtaaacgtccgaacgacccgtaacggtccctccggcccccgtcggtacctaccgttctacccgttccccctaccctccg

SEQ ID NO: 329641 - DNA, 785 bp, Homo sapiens
  misc_feature: GZ8MTXP02FKM1F.52.74.G08.1.454.CMB.2.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggccacaattaccnggcggggganacaatattgtgaccagacatgtgcactggtatcagcagaagccaggccaggcccctgtcctggtcatctagtagggattagtaagccggccctcgtaggaacttcccctagacgcgtatttcccgacgtgggaccgtacctaaacgttccgggaacctaaaccgacccgggaccccaaacccccgttagaacccctaagttacccgaaaggttacggaaaccggtacccccgaaacgggttacccgggggtaagttacgggaacgggtaccgtacggtaaacccgttaaccgttaccggttcggttaccggtaacggggttagggttacgggggaacgacgggaccggggtactaaccgttagttacggttacggtttttaccgggggaccggggtaaacgggggtaaacccgtaaacgggtttaccggtaaccccggtttaccgttaaaacggttacccgtaaacggtaccccgaaaacgggtcccgtaacccggtccccccgttaccggggtaccctaaccccgttccgttaccccggtttacccccctaaccccgtttcccccg

SEQ ID NO: 329642 - DNA, 597 bp, Homo sapiens
  misc_feature: GZ8MTXP02FM1EX.52.74.G08.1.454.CMB.2.raw
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (334)..(334): a, c, t, g, unknown or other
  misc_feature (334)..(334): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggccacaattacctgcggggganacaatattgtgaccagacatgtgcactggtatcagcagaanccaggccaggcccctgtcctggtcatctataggatattaagcggccctctggaatccctgagcgattccactggcncaattcggacacgcggccacctgaccatcagtgaacgcccgaagtcggggatgaggctgactacgtcgtgtcgaggtggtgggacgaggcggacaccgtagtgtacgttttcgggacggtacggggaccgtaaaggttacggtacccggtaccgttaacggttaccgacggtaccccgaaacgggcccgttaccggccccccgttacccggggttacccaacccgtttccgttaccggtttccccctaccccgtttacccccg

SEQ ID NO: 329643 - DNA, 636 bp, Homo sapiens
  misc_feature: GZ8MTXP02H66C9.52.74.G08.1.454.CMB.2.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (338)..(338): a, c, t, g, unknown or other
  misc_feature (338)..(338): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacgccanaataccngcgggganacaatattgtgaccagacatgtgcactggtatcagcagaagccaggccaggcccctgtcctggtcatctagtaggataattaagcggcctcgtggaactccctgacgcgtattcccacgtggcnccaagttcggacaacacggccacccgtgaacccatcagtacgaacgacccgaaacggtccggggaaagtcggtacgggtacgtacggaaccgtaaccgttcggtacggtaccggtaggggttagggttacgggggaacgtacgggaccgggaccgtaacggtaacgttaggtacggttttcggggacgggtaacgggaaccgtaaacggttacggaccgttaccgtaaacgtcgacgacccgaacggcctaccggcccccgtcggcctaccgtcctccgttaccccacccttaccccg

SEQ ID NO: 329644 - DNA, 598 bp, Homo sapiens
  misc_feature: GZ8MTXP02GL5XA.52.74.G08.1.454.CMB.2.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagcgcagtacgacacgaccggtgctcgatttagtagctctatcaggggctgggcctcaggaagcagcatcgggggtgccgcagccatggcctggaccgctctccttctgagccctccttgttcactttacaggttgtctggcctcctatgaactgactcagcctctctcagtgtcaggtcggccctgggacagacggccacaattaccnggcgggganacaatattgtgaccagacatgtgcacgtggtatcagcagaagccaggccacggcccctgtcctggtcatctagtaggatataagcgccctntggaactccgngagcgtattcccactgccgccaagttccggacaaccgaccggcccacccgtgaacccatccaagtcgaacgacccaaggtacggggagtacggaggtcgtagaccgtacgtccgtgtccgtaggtggtcggggagaggccgggacacgtagttgtacggttttcgggacggtagggaccgtaaggtacggtaccgtaccgtaacgtacgacgacccgaacggtccgtccgtaacccccgtccggtctacctccgtccgttccccgtccctttcccc

SEQ ID NO: 329645 - DNA, 616 bp, Homo sapiens
  misc_feature: GZ8MTXP02GW1BH.52.74.G08.1.454.CMB.2.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (459)..(459): a, c, t, g, unknown or other
  misc_feature (459)..(459): n is a, c, g, or t
tcagcgcagtacgacacgaccggtgctcgatttagtagctctatcaggggctgggcctcaggaagcagcatcgggggtgccgcagccatggcctggaccgctctccttctgagcctccttgttcactttacaggttgtctggcctctatgaactgactcagcctctctacgagtgtcaggtcggccctggggacaggaccggccaactaattaccgtggacgggggganaacgtaatagttgngaccagacatcgtgcacgtggtatcgagcagaacgccgaggccaacggcccctggtccctggtacnttcgtagtagggataagttaagccgggtccctntacgggaactcccgtagacgcggtattccgacgtagggcaccgtaagtcggacaacgccgggtaccaccgtcgaacacgtcagacgaagacccgtaggacggagacggagcccgtanaaggttacctcgtagtacgagggttacggacggacgacggacgacgtagttagtcggttagttacgggcgaacgggtagtaacggtacgacgtacgtaacgcgaacggccgacgtcccgtcgaacccgtcgtacctacgtctccgtaccctccgtac

SEQ ID NO: 329646 - DNA, 522 bp, Homo sapiens
  misc_feature: GZ8MTXP01CSXP4.44.17.B06.1.454.CMB.2.raw
  modified_base (461)..(461): a, c, t, g, unknown or other
  misc_feature (461)..(461): n is a, c, g, or t
  modified_base (514)..(514): a, c, t, g, unknown or other
  misc_feature (514)..(514): n is a, c, g, or t
tcagacagtatatacacgaccggtgctcgatttagtcgatagtgaaggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggcaaaccccccaaactcttgattcatgaaatctctaagcggccctctgggatttctgatcgccttctctggctccaaggtcccggcaacacggcctccctgacaatctctgggctccagcctgaggacgaggctaaatatttctagttcctcatatacacgtcttgttggttggtcttcggtcggagggccgnggtgacgttctaggttcagccaaggcttcgcccctggtcactcttcgttcccncccttccc

SEQ ID NO: 329647 - DNA, 404 bp, Homo sapiens
  misc_feature: GZ8MTXP01ATWFI.44.17.B06.1.454.CMB.2.raw
  modified_base (398)..(404): a, c, t, g, unknown or other
  misc_feature (398)..(404): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaaggggaccacggtcaccgtctcctcagcttccaccaagggcccatcggtctcccctggcgccctgctccaggagcacctctgggggcacgagcggccctgggctgcctggtccaaggctacttcctatatactgtctgagcgggctggcaaggcgcatagnnnnnnn

SEQ ID NO: 329648 - DNA, 405 bp, Homo sapiens
  misc_feature: GZ8MTXP01AM6CU.44.17.B06.1.454.CMB.2.raw
  modified_base (399)..(405): a, c, t, g, unknown or other
  misc_feature (399)..(405): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctgggggccaagggaccacggtcaccgtctcctcagcttccaccaagggcccatcggtctccccctggcgccctgctccaggagcacctctgggggcacagcggccctgggctgcctggtccaaggctacttcctataatactgtctgagcgggctgggcaaggcgcatagnnnnnnn

SEQ ID NO: 329649 - DNA, 405 bp, Homo sapiens
  misc_feature: GZ8MTXP01DDBPD.44.17.B06.1.454.CMB.2.raw
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (399)..(405): a, c, t, g, unknown or other
  misc_feature (399)..(405): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattacngtgcaagngccggtgcgggagttcggggattgcatactactactaggtatggacgtctgggggccaaaggggacccacggtcaccgtctcctcagcttccaccaaggcccatcggtctcccctggcgccctgctccaggagcacctctgggggcacagcgccgtggctgcctggtccaaggactacttcctataactactgtctgagcgggctgggcaaggcgcatagnnnnnnn

SEQ ID NO: 329650 - DNA, 402 bp, Homo sapiens
  misc_feature: GZ8MTXP01BAUF7.44.17.B06.1.454.CMB.2.raw
  modified_base (397)..(402): a, c, t, g, unknown or other
  misc_feature (397)..(402): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccacaagggcccatcggtctcccctggcgccctgctccaggagcacctctgggggcacagcggccctgggctgcctggtcccaaggactactcctataatactgtctgagcgggctggcaaggcgcatagnnnnnn

SEQ ID NO: 329651 - DNA, 425 bp, Homo sapiens
  misc_feature: GZ8MTXP01A7LLU.44.17.B06.1.454.CMB.2.raw
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
  modified_base (419)..(425): a, c, t, g, unknown or other
  misc_feature (419)..(425): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaaggggacccacggtcaccgtctcctcagcttccaccagggcccatcggtcttcccccnggcgccctgctccaggacgcaccctcgtggggggcacgaggccggcccgtggggcctcggcccgtggtcccaagggactacttcctataactactgtctgagcgggctgggcaagggcncatagnnnnnnn

SEQ ID NO: 329652 - DNA, 545 bp, Homo sapiens
  misc_feature: GZ8MTXP01BAF85.44.17.B06.1.454.CMB.2.raw
  modified_base (538)..(538): a, c, t, g, unknown or other
  misc_feature (538)..(538): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggcaaaccccccaaactcttgattcatgaaatctctaacgcggccctctgggatttctgatcgccttctctggctccaacggtcccgcaacacggcctccctgacaatctctgggctccagccctgacggacgaggtactaaattactttctgttcctctatactacacgttcttggttggttgggtcgttcggcggagggaccgtggtgaccgttcgtacggttcgagcccaaggccttcgcccctcggtccaccgtcttcgttccccnccttccc

SEQ ID NO: 329653 - DNA, 535 bp, Homo sapiens
  misc_feature: GZ8MTXP01AP824.44.17.B06.1.454.CMB.2.raw
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (404)..(404): a, c, t, g, unknown or other
  misc_feature (404)..(404): n is a, c, g, or t
tcagacagtatatacacgaccggtgctcgatttagtcgatagtgaaggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacactcccggcaaaccccccaaactccttgattcatgaaatctctaagcggccctctggatttcngatcgcttctntgctcaggtccgcacacgctccctgacatctctggctcagcctgaggacgaggactaattaatttctnttctccatatacacgtcttgttggttggtcgttcggtcgggaggaccggaggtgacgttccgtacggttcgacgccgaacggcgttcgtcccctccgggtccgtcctccgttcttcccgttccccttcccc

SEQ ID NO: 329654 - DNA, 696 bp, Homo sapiens
  misc_feature: GZ8MTXP01CWB3C.44.17.B06.1.454.CMB.2.raw
  modified_base (371)..(371): a, c, t, g, unknown or other
  misc_feature (371)..(371): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctctgcactggactcagcagtgaggctcaacttctaatgtcgcctctggtatcaaacaacactacccgaccaaaccccccaaatctgattcatagaaatctactaacgccggcccttcgtgggtatttcgtgatcgtccttctctggtctccgaagggtcccgcaaaccncgggtccctcccgtagactaactcctctcgggcctcgacgcccgtaggaacggacggtaggtaccttaaaattactttactcgtttcctacgtaactttaactaccgtacgtttccgtttggtttcgggtttcggggttccgtttaccggggcggggtaacggggtacccggtaaggggttccggtaacccgggttcggtacgggttacccgaacgggtaccccgttaaacggggttccgttacccgggtcccccccgttcgggggttaacccttccccggtttccgttccccggggtttccccccgttccccgttttaaccccg

SEQ ID NO: 329655 - DNA, 615 bp, Homo sapiens
  misc_feature: GZ8MTXP01EDI1M.44.17.B06.1.454.CMB.2.raw
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
  modified_base (527)..(527): a, c, t, g, unknown or other
  misc_feature (527)..(527): n is a, c, g, or t
  modified_base (587)..(587): a, c, t, g, unknown or other
  misc_feature (587)..(587): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgagctacaacttcttaatgtcgcctcctggtacncaacaacactacccgaccaaaaccccccaatcttagattcatanaaactctactaagccggtccctgtggtatttcagtactcgtccttctctcgctccgaacggtccgcaccgcgtccctcctagactaagtcctcgtcggtactccgagtcctaggaacggacgtaacgtacttaaacttatttccttcgttcctagtaacttaattaccgtacgttcgtttggttcgggtttcgggtaccgtttcggggacggggtacgggtaccgngggtcgtaccggttcgtacgggttcgacgtcccgagcccgttaccgtccccgtcggtccnccgttccgttccgttccccgccgtttcc

SEQ ID NO: 329656 - DNA, 807 bp, Homo sapiens
  misc_feature: GZ8MTXP01CPOI9.44.17.B06.1.454.CMB.2.raw
  modified_base (181)..(181): a, c, t, g, unknown or other
  misc_feature (181)..(181): n is a, c, g, or t
  modified_base (213)..(213): a, c, t, g, unknown or other
  misc_feature (213)..(213): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtcncctggacagtcgtcaccatctctgcactgganccagcgtaatattcttagtcttaactttgtctcgtgtatcaacatcatccaacggtaaacaccccaaactcaatcatctatgacgacctaagtaacgacggtcccctacggtacggggttttactaaacgttcgtaccttacctacccctcgtacccttacccgtaaaccggttccccgggaaacccaaacccgtaacccgggtccccttaccccgtacggtaaaccctaaacgttccgttacggttcggggtcccttacccgagggtaccgttagggaaccgggaaccgggtacgggttaccttaggttaaactttttaagtttaacgtttaggtttacggtaccctttacggggtaagtttaacggtttccggttccggttaaccgtaccgtaactttaccgttaaccttttaagtcgggtttaccgtttaaccgggggaaacggggtttaaccggggaaacccggttaacgggtaccccgttaacccggtttaacccggtacggttaacccgacccgggaccccgtaaaacccgggacccctaaacccccgtacgttcggttacccttaacccgttcccgtttaacccccg

SEQ ID NO: 329657 - DNA, 600 bp, Homo sapiens
  misc_feature: GZ8MTXP01A04L8.44.17.B06.1.454.CMB.2.raw
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgagctcaacttcttaatgtcgcctcctggtancaaacaacactcccggaccaaaccccccaaatcttgattcatgaaatctctaagccggccctgtgggtatttctgatcgccttctntcggctccaaggtcccgctaacacggccctcctgactatctctgggctccgagcctgaggacgaggacttaaaatntttcngtttccctgtaacttataccgtacgttcgtttggttgggtttcgggtcgtttcggggcgggtacgggtacccggtaggggtccgaacccggttcgtacggggttcacggccccgaagggttcccttaccggcccccctgggtaaccctccgtccgttccgttccccgttccctttccc

SEQ ID NO: 329658 - DNA, 661 bp, Homo sapiens
  misc_feature: GZ8MTXP01EHL33.44.17.B06.1.454.CMB.2.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcacctttcncctgccatggactcagcagtgagctacaacttcttaatgtcgcctcctggtatcaacaacnctacccggaccaaaccccccaaactcttgattcatgaaatctactaagcgccctgtggtatttcngatcgccttctctgctccaacggtccgcaacaccggcctccctagacacttcnctgggactccgagcctgacggacgtaggaccttaaattacgttctacgtttcccttacgtaaactttaacgttaaaccgtttccgtttagggtttcggggtttcggggtttccgtttaacgggggtccgggtaacgggggtacgtacggggtacgtaacccggttcgttacgggttacccgacggtaccccgaaaggggttcccgttccggttaccccccgttcgggttacccaaccgtttccctacggtttccccctaacccgtttccccgtttaac

SEQ ID NO: 329659 - DNA, 756 bp, Homo sapiens
  misc_feature: GZ8MTXP01DEV6A.44.17.B06.1.454.CMB.2.raw
tcagacagtatatacacgaccggtgctcgatttagtcgatagtgaagggggtcacaagaggcagcgctctcgggacgtctccaccatggcctgggctctgctgctcctcactctcctcactcaggacacgagggtcctgggcccagtctgccctgactcagcctgcctcgtgtctgggtatcctggacagtcgactcaccttctcctgcactggactcagcagtggacggtctactaactttcttaaatcgtccgcttccgtgtactacaaacaactaccgtcccgaacctaaaacccccctaactcttagattcaatagaaactctacgtaacgccgtcccgttcgtagggttctttctagacttccgtccttctcgtgtcccgtacccgtaaccggggttcccgcgaaaccgtacccgggtccccttacctaccgaactaacttcccgtcgttcgggtccttaccgacgtccgtacgaacgggtaacggtaacggtaacttaaagttactttacttacgttcccttacgtaacttacgttaaaccttcgtttccgtttgggtttcgggtttcggggttaccggttccggggtacggggtaccgggggtaaccgggtacggggttaaccggttaccggttaccggtttacgggttccgaccgggtcccgttaaaccggttcccgttaccccggtcccccggttacccggttccggtaccttcccgttcccgtttccccggttccccgttttcccg

SEQ ID NO: 329660 - DNA, 604 bp, Homo sapiens
  misc_feature: GZ8MTXP01AWL9Y.44.17.B06.1.454.CMB.2.raw
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
  modified_base (587)..(587): a, c, t, g, unknown or other
  misc_feature (587)..(587): n is a, c, g, or t
  modified_base (600)..(600): a, c, t, g, unknown or other
  misc_feature (600)..(600): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttctaatgtcgcctctgtatcaacacactcccgaccaaacccccaatcttagattcatgaaactctactaacgtccggccccttgtggggtactttctgacttccgtcctttccttacgtcggcccttacccgaaacgggttccccggaacctaacgacccgggtcccctaccccgtagaacctaaattcctcgtcgggctcccgagcccgtggaacggacgtaggacttaaattatttctagttcctntacttatactcgtttcgtttggtggtttcgggtacgtcgggtcgggacggtaccggnggtcgaccgttcgtaggttccgagtcccgagcttccggccctcggtcncgtcttcgtcccncttc

SEQ ID NO: 329661 - DNA, 398 bp, Homo sapiens
  misc_feature: GZ8MTXP02IG087.44.17.B06.1.454.CMB.2.raw
  modified_base (395)..(398): a, c, t, g, unknown or other
  misc_feature (395)..(398): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaaggccatcggtctcccctggcgccctgctccaggagcacctctggggcacagcggccctgggctgcctggtccaaggactacttcctatatactgtctgagcgggctggcaagggcgcatagnnnn

SEQ ID NO: 329662 - DNA, 399 bp, Homo sapiens
  misc_feature: GZ8MTXP02GUZ6H.44.17.B06.1.454.CMB.2.raw
  modified_base (396)..(399): a, c, t, g, unknown or other
  misc_feature (396)..(399): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtctccccctggcgccctgctccaggagcacctctggggcacagcggccctgggctgcctggtccaaggactactcctatatactgtctgagcgggctggcaaggcgcatagnnnn

SEQ ID NO: 329663 - DNA, 400 bp, Homo sapiens
  misc_feature: GZ8MTXP02HK6N4.44.17.B06.1.454.CMB.2.raw
  modified_base (397)..(400): a, c, t, g, unknown or other
  misc_feature (397)..(400): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggcctgggctgcctggtccaaggactacttcctatatactgtctgagcgggctggcaaggcgcatagnnnn

SEQ ID NO: 329664 - DNA, 398 bp, Homo sapiens
  misc_feature: GZ8MTXP02GI9F3.44.17.B06.1.454.CMB.2.raw
  modified_base (396)..(398): a, c, t, g, unknown or other
  misc_feature (396)..(398): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtccaaggctacttcctatatactgtctgagcgggctggcaaggcgcatagnnn

SEQ ID NO: 329665 - DNA, 400 bp, Homo sapiens
  misc_feature: GZ8MTXP02HIYVH.44.17.B06.1.454.CMB.2.raw
  modified_base (395)..(400): a, c, t, g, unknown or other
  misc_feature (395)..(400): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggacccacggtcaccgtctcctcagcttccaccaagggcccatcggtctccccctggcgccctgctccaggagcacctctggggcacagcggccctgggctgcctggtccaggactacttcctatatactgtctgagcgggctggcaggcgcatagnnnnnn

SEQ ID NO: 329666 - DNA, 394 bp, Homo sapiens
  misc_feature: GZ8MTXP02JCSBI.44.17.B06.1.454.CMB.2.raw
  modified_base (392)..(394): a, c, t, g, unknown or other
  misc_feature (392)..(394): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcgggagttgcatactactactacggtatggacgtctggggccaagggaccacggtcaccgtctcctcagcttccaccaagggcccatcggtcttcccctggcgccctgctccaggagcacctctggggcacagcggcctgggctgcctggtccaaggctacttcctatatactgtctgagcggctgcaaggcgcatagnnn

SEQ ID NO: 329667 - DNA, 404 bp, Homo sapiens
  misc_feature: GZ8MTXP02JOI49.44.17.B06.1.454.CMB.2.raw
  modified_base (394)..(394): a, c, t, g, unknown or other
  misc_feature (394)..(394): n is a, c, g, or t
  modified_base (400)..(404): a, c, t, g, unknown or other
  misc_feature (400)..(404): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcgggagttgcatactactactacggtatggacgtctgggggccaagggaccacggtcaccgtctcctcagcttccaccaagggcccatcggtcttccccctggcgccctgctccaggagcacctctgggggcacagcggccctgggctgcctggtccaaggactacttcctatatactgtctgagcggggctggcaaggcncatagnnnnn

SEQ ID NO: 329668 - DNA, 538 bp, Homo sapiens
  misc_feature: GZ8MTXP02J07XO.44.17.B06.1.454.CMB.2.raw
  modified_base (431)..(431): a, c, t, g, unknown or other
  misc_feature (431)..(431): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttctaatgtcgcctcctggtatcaacaacactccccggcaaaccccccaaactcttgattcatgaaatctctaagcgccctctgggatttctgatcgccttctctggctccgaggttccgcaacaccggccctccctgacaatcctctcgggctcccagccctgacggacgaggtactaaagttatttctgttcctanatatacacgttcttggttcggtttggtcgtttcgggcggagggaccgaggtcgaccgtctacggtcacgccaggctcgccccgtggtcacttctcgttcccacttcc

SEQ ID NO: 329669 - DNA, 520 bp, Homo sapiens
  misc_feature: GZ8MTXP02HYV88.44.17.B06.1.454.CMB.2.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcggtcaccatctcctgcactgganccagcggtaatattcttagtcttaacttgtctctgtatcaacatcatccaggtaacncccccaaatcatcatctatgagcctataagagccctgagggtttcaatcgcttcactgcctcaagtccgcaacncggcctcctgacaatctctcgggctccgaggctgaggacgaggctgtattattattgttgctgagtatgttcgtcgcatctacttatgtacgttacggaagttcgggaactaaggtcctacggtccctaggtcaacgcccaaacggcccaaacccgactcgtaccacttctccg

SEQ ID NO: 329670 - DNA, 371 bp, Homo sapiens
  misc_feature: GZ8MTXP02FSPCR.44.17.B06.1.454.CMB.2.raw
  modified_base (363)..(363): a, c, t, g, unknown or other
  misc_feature (363)..(363): n is a, c, g, or t
  modified_base (368)..(371): a, c, t, g, unknown or other
  misc_feature (368)..(371): n is a, c, g, or t
tcagacagtatatacacgaccggtgctcgatttagtcgatagtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctcccaggacgcacctcgtcggggcacagccggcccctgggctgcctggtcaaggctactcctatatactgtctgagccgggctggcaaggcncatgnnnn

SEQ ID NO: 329671 - DNA, 594 bp, Homo sapiens
  misc_feature: GZ8MTXP02J5BTV.44.17.B06.1.454.CMB.2.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (472)..(472): a, c, t, g, unknown or other
  misc_feature (472)..(472): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctggtatcctggacagtcggtcaccatctcctgcactggagccagcgtaatnttcttagtcttaacttntctcctgtatcacaatcacgaccacggtaaacgacccccaaacctacatcatctatgaaggcctataaaagcggaccctcgtaggggttttctaaatcgcttcaccctgcctccaacgtccggcacnccggcctccctcgacanctcttcgggctaccgacggctggagggacaggggacttgatttacttaatttgtttcgtattcctgtaacgttgtcgggtttcccncgtaactactacgttaattgttcgttacggtaacggtacggtacggtaacgacggtaccgtaccgtaccgtcgtaccgacccgaacgaccccgaacccttacccaccgtctacctaccttcg

SEQ ID NO: 329672 - DNA, 533 bp, Homo sapiens
  misc_feature: GZ8MTXP02IFOJ8.44.17.B06.1.454.CMB.2.raw
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggacaaaccccccaaactctgattcatgaaatctctaagcggccctctgggatttctgatcgcctttctctggctccgaggtccggcaaccacggccctccctgacaactctctgggctccgagcctgagacgaggactaaatatttctgttcctcatatacacgttcttgttggttggtcgttcggcggagggcgtaggtcgaccgtcctacggtcacgtccaacggctcgccccgtcggtcactcctcgtccccacccttccc

SEQ ID NO: 329673 - DNA, 682 bp, Homo sapiens
  misc_feature: GZ8MTXP02JUAHT.44.17.B06.1.454.CMB.2.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgagctcacttntatgtcgcctcctgtatcaacacactcccggaccaaaccccccaatcttagacttcatagaaatctactaacgccggccctcgtggtactttcngatcgcttcctcgtgcctccgacggttcccgacgaaccgccggtcccttacccgngaacctaacttcctcgtcgggacctccgagccctagacggaccgagtacttaattactttctacgttcctactacttactaccttaccggtttgtttggtttacgggggtttcggttcggttccgggggacggggtaacggggtacccggtagggttacccggtacccgggttaccgttacggggtaacccaccggtaacccccgtaaaccgggacccccgaaaacccctaaccgttccggttaaccctacccgtttacccggtttccccgtttacccccctaaccccgttttaccccg

SEQ ID NO: 329674 - DNA, 734 bp, Homo sapiens
  misc_feature: GZ8MTXP02IH8R7.44.17.B06.1.454.CMB.2.raw
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatccaccttctcctgcactggactcagcagtgaggctctaacttcttaatgtcgcctcctgtatcaacaacactcccgaccaaacccccaactcttgactcatacgaatctacgtaacgccggtacccttcgtgggtactttcgtgtacttcgtcctttctcgtcggtcctccgtacggttcccggcaaccgtaccgggtccccttacccgtacgtacctaaacttccgtaccgttcgggcccttcccgaacgtcccgtagggacgggtaaccggtaaggtaaccttaaaacgtttactttccgtttacgtttcccttaactaactttaagtaccttaccggtttcgtttggtttcggggtttcggggttccgtttccgggggaccgggggtacggggtaacccgggtaagggttccgggtacccggtttaccggtaacggttaccgaaccggtaccccgaacgggttcccgtccggtccccccggttcggtcccgtaccgttcccgtttaccccggtttccccccttaacccctttcccg

SEQ ID NO: 329675 - DNA, 525 bp, Homo sapiens
  misc_feature: GZ8MTXP02F8O0W.44.17.B06.1.454.CMB.2.raw
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (517)..(517): a, c, t, g, unknown or other
  misc_feature (517)..(517): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatccaccttctcctgcactggactcagcagtgagctcaacttcttaatgtcgcctcctggtatcaacacactcccgacaaacccccaatctgatcatnaatctactaagcgccctntgggtatttcnactcgccttctctgctcaggtccgcacacgcctcctagacatctcnggctcagctgaggcgaggactaaatactttctgttcccatattactactacgttcttgttggttggtcgttcggcggacggtcgaggtcgaccgtcgtaggtcgacgtcccgaaggctccgccccgtcggtacctctcgtccggttccccncctttccc

SEQ ID NO: 329676 - DNA, 641 bp, Homo sapiens
  misc_feature: GZ8MTXP02IBBEJ.44.17.B06.1.454.CMB.2.raw
  modified_base (474)..(474): a, c, t, g, unknown or other
  misc_feature (474)..(474): n is a, c, g, or t
tcagacagtatatacacgaccggtgctcgatttagtcgatagtgaagggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcccttcctggtatcaaacaacactccccggaccaaaacccccccaaatcctttagatttccatagaaatctactaaagccggaccctcgtgggtatttctgtactcgtacccttctcgtcggctccgacggtcccggcaaaccgacggccctcccgtagaccaattcctcgtcgggccttccgagccctaggacggacgaggtacctaaattactttctcgttaccctntaacttatactacgtttctttggtttgggtttcgggttcgttcggggacgggtacggggtaccgtagggttccggaaccggtttccgaggttcccgaacggtacccgaacggtcctccggtcccccgtcgggtacctaccgtccgttccgttccccgtccctttccc

SEQ ID NO: 329677 - DNA, 481 bp, Homo sapiens
  misc_feature: GZ8MTXP01EB7WZ.13.85.H08.1.454.CMB.2.raw
  modified_base (131)..(131): a, c, t, g, unknown or other
  misc_feature (131)..(131): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagtcacgtactacacgaccggtgctcgatttagtatcactcagtcgcgggagcatcatcaacaaccacatccttctctacagaagcctctgagaggaaagttcttcaccatggactggacctggaggtnttctgcttgctggctgtagctccagtgttcataccagtacaactgtgcaatctgggctgaggtgacgaagcctgggcctcagtgaagctttcctgcaagtcatctgggtacagcttcacagccactacatgcactggtccacaggcccctggcaaggtcttgagtggatggactaatcactccaatggtgatggactgacctagcacagaagtttcagggcagagtcacatgacaggacacgtcacgagaacagactattgagttgagcagctgagntcngacanacgtcgtttaatcttgtgcgngaagattattagtcanaacgtggacggttgtttgggttgttcgg

SEQ ID NO: 329678 - DNA, 611 bp, Homo sapiens
  misc_feature: GZ8MTXP01CVY98.13.85.H08.1.454.CMB.2.raw
  modified_base (405)..(405): a, c, t, g, unknown or other
  misc_feature (405)..(405): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagtctttcctgcaagtcatcgtgggtacagcttcaccagccactacatgcacgtcgggtccgacgacggcccccgtgggcaaggtcttggagtggatgggactaatcactccaagtcggtgagtggggactggaccctaacgcaacgaagtaagtttcgagggcagacgtacaacanacgacgaggacacgtaccgaagaacgaacagtactagttggaggttgagtcacggcctagagtatacgtacgaaccggtaccgtaccgggttacccgtttaagttaaccgttggttacgccggtaacgaagttaattaagttacgttaacaacgtaacggtacggggtaacgggttcgggttttggggttcgggtttaacccgggg

SEQ ID NO: 329679 - DNA, 511 bp, Homo sapiens
  misc_feature: GZ8MTXP01DM5OQ.13.85.H08.1.454.CMB.2.raw
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactatcactccaatggtgatgggactgccctagcacagaagtttcagggcagagtcaccatgaccagggacacgtccagagaacagactaattgaggttnagcagcctgngatctgacgacncggtccgtttaatacttgtgccgngagattattagtcaacaactgggacggttggtttggggttggttcggg

SEQ ID NO: 329680 - DNA, 533 bp, Homo sapiens
  misc_feature: GZ8MTXP01DCRWY.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgatgaagccgtggggcctcagtgaagctttcctgcaagtcatctgggtacagctcacagccactacatgcacgtggtccgacacggcccctgggcaaggtctggagtggagtgggactaatcactcccaaatcggtagagtgggactcgcctaacgcacaagtaagttcgagggcagagtcaccatagaccgaggacacgccacgagaacagactagttggggagttgagcgagcctagagtatcgtagacgacgaacggtcgtttaattacgtgttgcgcgagattaataagtacaacgagtgggttaaccgggtggtttggggtcggg

SEQ ID NO: 329681 - DNA, 529 bp, Homo sapiens
  misc_feature: GZ8MTXP01C48LC.13.85.H08.1.454.CMB.2.raw
  modified_base (336)..(336): a, c, t, g, unknown or other
  misc_feature (336)..(336): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (518)..(518): a, c, t, g, unknown or other
  misc_feature (518)..(518): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactggtccgacaggcccctgggcaaggtcttgagtggatgggactaatcactcccaatggtnatgggactgacctacgcacagagtttcaggggcagagtcaccatcgacgaggacacgtaccagagaacagactaagttggaggttgagtcagcctgagatcgtgacgacacggtcgtttaatacgttgtgcgnganaagttattacgtcaactaacgtggaacgggttcggttttaaggggnggtttccgggg

SEQ ID NO: 329682 - DNA, 553 bp, Homo sapiens
  misc_feature: GZ8MTXP01EYMYO.13.85.H08.1.454.CMB.2.raw
  modified_base (419)..(419): a, c, t, g, unknown or other
  misc_feature (419)..(419): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttcctgcaagtcatcgtgggtacagcttcaccagccactacatgcactgggtccgacgacggcccctgggacaaggtcttgagtggagtgggactagtcactcccaagtcggtgagtgggactcgaccctacgcacagtaacgttcgagggtcagacgtcaccatacgacagggacacgtacaacganaacagactagttggaggttgagtcagcctgagtatcgtgaccgacgtaccggtccgtttaatacgttgagttccgagagattagttacgtcaacgtaacgtgggtaccggttgggtttgggggttggttccggg

SEQ ID NO: 329683 - DNA, 567 bp, Homo sapiens
  misc_feature: GZ8MTXP01BA8Y7.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagcttcctgcaagtcatctgggtacagcttcaccagccactacatgcactggtccgacacggcccctggcaaggtctgagtggatggactaagtcactcccaatcggtgagtgggactgccctacgcacagaagtttcgagggcagcgtcaccatcgacagggacacgtccaacgagacgacgagtacgttagttaggggtagttggacgacgacgccgtggagtacgtcgtacggaaccgtacgcgggttaacctttagttacgtgttcgaccgtagagttagttagtaacgtacaacgtacggtacgggttaccggttcggggtttgggttaaccgggg

SEQ ID NO: 329684 - DNA, 559 bp, Homo sapiens
  misc_feature: GZ8MTXP01AW1BU.13.85.H08.1.454.CMB.2.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctnagtgaagcttccngcaagtcatcgtgggtacagcttcacagccactacatgcacgtgggtcccgacgacggcccctgggcaaggtcttggagtggagtgggactatcactccgaatggtgagtggactgacctacgcacgagtaagttcgagggcagacgtcacagtcgaccgaggacacgtacacgagaacagactagttcggaggttgagcgacgcctgagatcgtacgacggactaccggtctttaatacgttgtcgcgtacgagaacttagttacgtaacacgtaacggtcgggtaacgggttcgggttttcgggggttcggtttaacccgggg

SEQ ID NO: 329685 - DNA, 525 bp, Homo sapiens
  misc_feature: GZ8MTXP01BJW60.13.85.H08.1.454.CMB.2.raw
  modified_base (235)..(235): a, c, t, g, unknown or other
  misc_feature (235)..(235): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttccngcaagtcatctgggtacagcttcaccagccactacatgcactgggtccgacacggcccctgggcaaggtcttgagtggatgggactatcactcccaatcggtgagtgggactgaccctacgcacagaagtttcaggggcagagtcacatcgaccgagggacacgtcacgagaacagactagttggaggttgagcagcctgagatctgacgacgacggtccgtttaatacttgtgcgacgagattattagtcacgaacgtgggacggttcggtttggggttgggttccggg

SEQ ID NO: 329686 - DNA, 531 bp, Homo sapiens
  misc_feature: GZ8MTXP01BQ05R.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccacacggcccctgggcaaggtcttgagtggatgggactaatcactcccaatcggtgatgggactgccctacgcacgagaagtttcgagggtcagagtcacatgacgaggacacgtccacgagaacagactagttggaggttgagtcaagcctagagatcgtggaccgactacggtccgtttaattacgttgtgcgcgagagttattagtcacaacgtgggacggttcggtttggggttggtttccgggg

SEQ ID NO: 329687 - DNA, 534 bp, Homo sapiens
  misc_feature: GZ8MTXP01DGRZ1.13.85.H08.1.454.CMB.2.raw
  modified_base (236)..(236): a, c, t, g, unknown or other
  misc_feature (236)..(236): n is a, c, g, or t
  modified_base (485)..(485): a, c, t, g, unknown or other
  misc_feature (485)..(485): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttccngcaagtcatctgggtacagcttcaccagccactacatgcactcgggtccgacgacggccccctgggcaaggtcttgagtggatgggactatcactccaatcggtgatgggactgacctacgcacagtaagtttcgagggcagagtcacatcgacgaggacacgtcaacgagaacagaactagttggaggttgaagcaagcctgagatctagacgacacggtccgttaatacgttgtcgcgagagattanagtaacacgtaacgtggaaggttcggtttaaggggttcggttaaccggg

SEQ ID NO: 329688 - DNA, 650 bp, Homo sapiens
  misc_feature: GZ8MTXP01DQKEV.13.85.H08.1.454.CMB.2.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatcgtgggtacngcttcaccagccactacatgcacgtcggtccgacacggccccgtggcaaggtcttgngtggatggactatcactccaatggngagtgggactgccctagcagagtaagttcgagggcagacgtcacancgacgaggacacgtccacgagaacagactagttggaggttgagcagtcctagacgtacttacgacggtaacggtaccgtaccggggttccgttttaaaccgttagttcggggttacgggacccggttacgggaaggttaaaagtttaaacgttaaacgggttaaccctaaaaacccgggtaaaccgggtttacggggggttaaaccccgggggtttcggggggttttttaaggggggggtttcggggttttttaacccccgggggggg

SEQ ID NO: 329689 - DNA, 559 bp, Homo sapiens
  misc_feature: GZ8MTXP01C9BI6.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgagcttcctgcaagtcatctgggtacagcttcaccagccactacatgcacgtgggtccacgacggccccctgggcctaaagggtcttggagtggagtgggactaatcactccaagtcggtgatgggactgccctacgcacagtaacgtttcgagggcagacgtcaccatcgacagggacacgtaccacgaagaacagacttagttggaggttggagtcagcctgagatcgtgacgactacggtccgtttaatcgttgtcgcgacgaagaagttaagacgtaacaactaacggtagggtaacgggttcgggttttgggggttcggtttaaccgggg

SEQ ID NO: 329690 - DNA, 527 bp, Homo sapiens
  misc_feature: GZ8MTXP01APZ11.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacacggcccctggcaaggtcttgagtggatgggactaatcactcccaatggtgagtgggactgcctacgcacagagttcgagggcagagtacacatcgacaggacacgtccagacgaacagactagttaggaggttgagcgagcctgagatctgacgacacggtccgttaatacgttgtgcgcgagattaattagtaacacaacgtgggaacggttcggtttaagggggttggttaaccgggg

SEQ ID NO: 329691 - DNA, 648 bp, Homo sapiens
  misc_feature: GZ8MTXP01B2410.13.85.H08.1.454.CMB.2.raw
  modified_base (341)..(341): a, c, t, g, unknown or other
  misc_feature (341)..(341): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttcctgcaagtcatctgggtacagcttcaccagcccactacatgcacgtcgggtcccgacgacgggccccctgggctaagggtcttggaggtggagtagggactaanccactcccaagtcggtgagtgggactgaccctacgcacagtagttcgagggcagacgtacaccagtcgaccgagggaccacgtaccaagacgaacagtaacttagtttagggaggttggacgcgaacgccgtagacgacttacgtacgaccggaccgtaccgggtttcccgttttaagttaaccgttggtcggaccggtaaccggtaaggttaaactttaaagttaacgtaaccgtaaaaccgtaaccggttacgggggtaaacgggtttccggggtttttaaggggggttcggtttaaccccgggg

SEQ ID NO: 329692 - DNA, 560 bp, Homo sapiens
  misc_feature: GZ8MTXP01COEBS.13.85.H08.1.454.CMB.2.raw
  modified_base (444)..(444): a, c, t, g, unknown or other
  misc_feature (444)..(444): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatcgtggtacagcttcaccagccactacatgccactcgggtccgacacggccccctgggcaaggtcttggagtggagtgggactaagtcaactcccaatcggtgagtgggactgacctacgcacagagtttcgagggcagacgtcacagtcgaccaggacacgtccacgagacagactagttggagttgagcagcctgagancgtgacgactacggtcgtttaattaccgttggtacgcggtacgaggacttaagttagttccaacgtaacgttagggaaacgggttcgggttttcgggggttgggttttcccggggg

SEQ ID NO: 329693 - DNA, 574 bp, Homo sapiens
  misc_feature: GZ8MTXP01D05R1.13.85.H08.1.454.CMB.2.raw
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagtctttcctgcaagtcatctgggacagcttcaccagccactacatgcacgtcggtccgacacggccccgtggacaaggtcttgagtggagtggactaatcacctccgaagtcggtgagtgggactcgaccctacgcagtagtaagttcgagggcagacgtcacatcgacagggacacgtcagagaacagactattggagttagngacgacgtcgngaangtacgtgaccgacgtacggttccgtttaatacgttggtcgccgtagtaagttaaagttattacggtaacaaccgtaacgtcggggtaaccgggttcgggttttgggggttcgggtttaacccgggg

SEQ ID NO: 329694 - DNA, 680 bp, Homo sapiens
  misc_feature: GZ8MTXP01BIPNY.13.85.H08.1.454.CMB.2.raw
  modified_base (240)..(240): a, c, t, g, unknown or other
  misc_feature (240)..(240): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcgagtgaagtctttccngcaagtcatcgtgggtacagcttcaccagccactacatgcacgtgggtccgacgacggcccccgtagggaccgtaagggttccttagggaggtagggtagtagggggaaccttaaatcccaaccgtaccccgtaaagtcgggtaggagtcgggggaaccttcggaacccttaacgccaacgaaggtaaacgtttcgagggtcaaggacgtaccaacgtagacgaccgaagggaccaccgtaccaacggacgaaacacgaacgttagtttaggaggttaggacgacgacgtccgtggaagagtacgtacgaacggaccgtaccggttcccgtttaagttacgttgtcggaccgtacggtaagttaacgttagttacgtaacgtaaccgtaaggtcgggtaaacgggttccgggttttaagggggcgggttttaaccggggg

SEQ ID NO: 329695 - DNA, 586 bp, Homo sapiens
  misc_feature: GZ8MTXP01A39L9.13.85.H08.1.454.CMB.2.raw
  modified_base (344)..(344): a, c, t, g, unknown or other
  misc_feature (344)..(344): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctgggctgaggtgacgaagcctggggcctcagtgaagtctttcctgcaagtcatctgggtacagcttcaccagccactacatgcacgtgggtccacgacggccccgtgggctaacggtcttgaggtggagtggactatcacctccgaagtcggngagtgggactgaccctacgcacgagtagtttcgagggcagacgtcacagtacgaccgaggacaacgtaccacggaacaacgagtacttagttaggaggttgagtcacgtctagagataccgagtaccgacgtaccggttccgtttaatccgttaggtcgcgtcgaagttaacgttattacgtaacaccgtaacgttggggtaacgggtttcgggttttaaggggttcgggtttaacccgggg

SEQ ID NO: 329696 - DNA, 536 bp, Homo sapiens
  misc_feature: GZ8MTXP01BHGS4.13.85.H08.1.454.CMB.2.raw
  modified_base (451)..(451): a, c, t, g, unknown or other
  misc_feature (451)..(451): n is a, c, g, or t
tcagtcacgtactacacgaccggtgctcgatttagtatcactcagtcgcgggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccacgacggcccccgtgggcaaggtcttgagtggatgggactaagtcactcccaatggtgatggggactcgacctacgcacagaagtttcgagggtcagagtcacatgaccgagggacacgtccacgagaacagactagttgaggttgagcagccgtgagatctgacgacncggtcgttaattcgttagtgcgacgagattaagttacgtaacacgtaacgtgggtaacggttcggttttggggttcggttcgggg

SEQ ID NO: 329697 - DNA, 630 bp, Homo sapiens
  misc_feature: GZ8MTXP01D7U6A.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaaggcctggggcctcagtgaagtctttcctgcaagtcatcgtgggtacagctcaccacgccactacatgcacgtcgggtccgacgacggccccgtgggacgtaaggtcttggaggtgagtgggactaatccactccaagtcggagagtcggactcgaccctacgcgaacgtagtaacgtttcgagggacaggactaccacgtagtacgaccgagggaccaaccgtacgaacggacgaacgagtaacttaggtttggaaggttagaggtacacggtaccgtaggacgtatacgtaggaccgtacgtaccgggttccgtttaattacggttggtcgcgacgtaaggattaacgttacgtaacaaaccgtaaggttacggggtagggttccgggtttttaagggggttcgggtttaacccgggg

SEQ ID NO: 329698 - DNA, 643 bp, Homo sapiens
  misc_feature: GZ8MTXP01DPM2T.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctgggctgaggtgacgaagcctggggcctcagtgaagctttcctgcaagtcatctgggtacagcttcaccagccactacatgcacgtcggtccgacacggccccgtgggcaaggtcttgagtggagtgggactaatccactacccaagtcggtagagtgggactcgacctacgcaacgaggtaaagttcgaggggcagacgtcaccatcgaccagggaccacgtcaaccggaagaacgagtaacttagttaggaggttagagacgagccgtaggatcgttacgcgtaaccggtaccgtaaccgggttccgttttaaacgtccgttgggccgttaccggaacgtaacggttaaattaacggttaccgttaaccgaaacccgttaacgggttacgggggttaacccggggttttgggggttttaacgggggtttccgggggtttaaccccggggg

SEQ ID NO: 329699 - DNA, 545 bp, Homo sapiens
  misc_feature: GZ8MTXP01BDO8F.13.85.H08.1.454.CMB.2.raw
  modified_base (234)..(234): a, c, t, g, unknown or other
  misc_feature (234)..(234): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcngcaagtcatctgggtacagcttcaccagccactacatgcacgtgggtccgacaggccccgtgggcaaggtcttgagtggatgggactatcactccaatcggtgatgggactggaccctacgcacagtaagtttcgagggcagagtcaccagtcgaccgagggacacggacagagaacagactagttggaggttgagngagctganatctgacgaccgtcggtccgtttaatcgttgtcgcggtacgagaattaagttacgtaacacgtaacgtagggacgggttcgggttttgggggttggtttcccgggg

SEQ ID NO: 329700 - DNA, 688 bp, Homo sapiens
  misc_feature: GZ8MTXP01DEWXX.13.85.H08.1.454.CMB.2.raw
  modified_base (363)..(363): a, c, t, g, unknown or other
  misc_feature (363)..(363): n is a, c, g, or t
tcagtcacgtactacacgaccggtgctcgatttagtatcactcagtcgcggggagcatcatccaacaacaacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtgggcctcagtgaagtctttcctgcaagtcatcgtgggacagcttcaccagccactacatgccacgtcgggtacccgacgaccgggcccccgtgggacctaaggttcgttggaggtggagtagggaactaatccacctccgaagtggngagtggactcgaaccctacgcgaacgaagtaaacgttcgacgggcgaaggtacgtaccaacctagtacggaacccgaacgggaaccctaaccggtacccaacggaaacgaaacgacgtaacgttaagtttacgggtaagggtttcggaaaggtccgaacggtcctaaggacgtactaccgtacgtaaccggtacgtaccggggtttacctttaagtttacgttcggtcggaccgtaggtaagttaacgttagttaacgtaactaaaccgtaacgggttacgggtacggggtttcgggtttttgggggttcgggttttaaccgggg

SEQ ID NO: 329701 - DNA, 585 bp, Homo sapiens
  misc_feature: GZ8MTXP01EH6LK.13.85.H08.1.454.CMB.2.raw
  modified_base (539)..(539): a, c, t, g, unknown or other
  misc_feature (539)..(539): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtgggcctcagtgaagtctttcctgcaagtcatcgtgggtacagtcttcaccacgccactacatcgcacgtcgggtccgacgacggccccgtggactaaggtcttaggagtggagtagggactaatccaactccaagtcggtagagtcggggactcgaccctacgcacgagtaacgttcgagggcagacgtacacagcgacgaggaccacgtacaagagaacagacttagttggaggttgagcacgcctagatacgtcgtacgaccgacgtacgggtctttaacgttcgttggtcgcgagaagttaattaagttacgtaacgaanaacggttgggtacgggttcgggtttggggttcgggtttaacccggg

SEQ ID NO: 329702 - DNA, 556 bp, Homo sapiens
  misc_feature: GZ8MTXP01ELTU5.13.85.H08.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (369)..(369): a, c, t, g, unknown or other
  misc_feature (369)..(369): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctnagtgaagctttccngcaagtcatctggtacagctcaccagccactacatgcactggtccgacaggcccctggcaaggtcttgagtggatgggactaatcactcccaatggtgatgggactgaccctagcacagaaagtttcaaggggnagatcacagacgacgacggacgacgtaccaacgaagaacacgaacgtagtttaggtagggttagagacgacgacgtagagagtacgtacgtacgacgtacggtacgttaacttacgttgtgcgacgaagaagttaattagtaacaacgaacgtagggtacgggttacgggtttggggttgggtcggg

SEQ ID NO: 329703 - DNA, 628 bp, Homo sapiens
  misc_feature: GZ8MTXP01C5PZY.13.85.H08.1.454.CMB.2.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtgggcctnagtgaagtctttccngcaagtcatcgtgggtacngcttcacagccactacatgcacgtcggccgacgacggccccgtggactaaggtcttaggagtggagtaggactatcacgtccaagtcggtagagtcgggactcgaacctacgtgtaacgtaagttcgagggcagtcgtacacagtcggaaccgacgggacctacggaccaacggacgaaacgagtacgttagttagggtagttaggaacgtacgtacgtaccgtagaacgtagtccgtaacggaaccgtaccgtaacgggttccgtttaagttaacgtggttacggcgacgaaagtaattaaacgttcgttacaacggtaagtaacgggtaacgggttcgggtttacggggtcgttcgggttaaccccggg

SEQ ID NO: 329704 - DNA, 554 bp, Homo sapiens
  misc_feature: GZ8MTXP01E3O08.13.85.H08.1.454.CMB.2.raw
  modified_base (236)..(236): a, c, t, g, unknown or other
  misc_feature (236)..(236): n is a, c, g, or t
  modified_base (345)..(345): a, c, t, g, unknown or other
  misc_feature (345)..(345): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttccngcaagtcatctgggtacagcttcaccagccactacatgcactgggtccgacaggcccctggcaaggtcttgagtggatgggactatcactcccaatcggtgatgggacngcctacgcacagaagtttcagggcagagtcacatgacaggacacgtccagagaacagactattggaggttgagcagctgacgatctgacgacgtaccgggtccgtttaattacgttggttcgcggtaccgaaggttattaaattacgtaaccaactaacgtagggtaacgggttcgggtttttaacgggggttgggtttaacccggggg

SEQ ID NO: 329705 - DNA, 610 bp, Homo sapiens
  misc_feature: GZ8MTXP01CV05C.13.85.H08.1.454.CMB.2.raw
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtcttttngcaagtcatcgtggtacagtcttcaccagccactacatgcacgtcggtccgacgacggccccgtggactaaggtcttggagtggagtggactagtccactccaagtcggtgagtgggactcgaaccctacgcacgaagtagttcgagggacagacgtaccacagtacgacgaacgggacaccgtaccgaacgagaaacgagaacgttagtttggaggttgagcacgccgtagagtacgtcgacgtaccgacgtaccggttctttaacgttacgttggtcgacgtacgtaattaacgttaacgttacgtaaccaacggtaacggtacgggttaaccggggtttgggttttcgggggttaacggtttcccgggg

SEQ ID NO: 329706 - DNA, 747 bp, Homo sapiens
  misc_feature: GZ8MTXP01ACABS.13.85.H08.1.454.CMB.2.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaacgtggtgcaatcgtgggctgaggtgacgagccgtgggcctgagtgaagtctttccngctaagtcatcgtgggtacngtcttcgaccagccactacatcgcacgtcggccgacgacggccccgtggacgtaacggttcgttaggaggtggagtggaactaactcacgtaccctaagtgggtacgagttacggggacctcgtaaccctaaccgggcaaacggtaaacggtaaacgggttttaccgaagggggttacaaacgggaacttaccgaaccgtaacggtcggaaacccggtacggggtaaccaacccggtacccgaaaccggaacgaaaacccgtagttaaccgtttaaggtttacgggaaggggtttacggaaggtccgtaacggacccgttacggagtacgtttaccgtacggaaccgtaaccgttaccggggttacccgttttaagtaaccgtttggcgttaccggacgtaacggttaagttaaacgttacgttaaccaacggtaaccgttagggggaaccgggttttcggggtttaagggggttcggtttaacccggggg

SEQ ID NO: 329707 - DNA, 628 bp, Homo sapiens
  misc_feature: GZ8MTXP01EN9XF.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcgagtgaagtctttcctgcaagtcatcgtgggtacagcttcaccagccactacatcgcacgtcggtccgacgacggccccgtggcgtaaggtcttgaggtggagtggactaagtcactccgaagtcggtgagtggctgacctacgcacgtagtaagttcgagggacagacgtccaccgatacgaccgaacgggacaccgtacgaacgaacgaaaccgagtaacttagttagggaggttagaacgcgaacggtcctggaagtacgttaccggaggtaaaccgtacgtaccgggttcgttttaaacgttaccgttgggtcgacggtacgaagttaaacgttagttaacgtaacgaaccgtaaaggtcgggtaacgggttcggggttttggggttaacgggttcccggg

SEQ ID NO: 329708 - DNA, 742 bp, Homo sapiens
  misc_feature: GZ8MTXP01B57BI.13.85.H08.1.454.CMB.2.raw
  modified_base (283)..(283): a, c, t, g, unknown or other
  misc_feature (283)..(283): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggtctaggaggtcgaacgacggtccggtcgggtcctacgagtagtaacgttcctttcgcgactaacgtctacgttcggtacgggtacncgtccttaccaccgacgacccaactactagcgccgtacgggttccgggaccgaccggtacccggtcccggtggacgtacggttcgtaggaggtaggtagtacgggtaactacgtacctaaccgtacccgtaggtcggtaggtacggtacggtactaccggtaacctaccgaacgtaacgtaaagttacggttaccggaggtacgaagtacgtacacgtagacgacggacggacctacgacgacgaacgaacgacgtattagtaggtaggtgacggactacgtccgaggactcgttacgacggtaccgtaccgtaacccggtttcgtttaaacgtcggttggtcgaccgtaagggtaaacgttaagttaacgttaccgtaacgtaaaccgttaaccggggtaacgggtttacgggggtttcgggggtttttaacgggggttcggttttaacccccggggg

SEQ ID NO: 329709 - DNA, 617 bp, Homo sapiens
  misc_feature: GZ8MTXP01A0S8F.13.85.H08.1.454.CMB.2.raw
  modified_base (328)..(328): a, c, t, g, unknown or other
  misc_feature (328)..(328): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctatagctccaggtgttcatacccaggtacaactggtgcaatcgtggggctggaggtgacgaagccgtggggcctcagtgaagtctttcctgcaagtcatcgtgggtacagcttcaccagccactacatgcacgtgggtccgacacgaccccgtggcaaggtctgagtggagtggactancactccgaagtcggtgagtcggactcgaacctacgcagtagtaacgttcgagggacagagtacacagtacgaccgagggacccacgtaccgaacgacgaaacacgtaacgttagttggagggttagacgcagcctagacgtagtacgtacgaaccgtaccgtaccggttccgttttaagttccgttggtacggcggtacggaagttaattaacgttacgtaacctaacgtaacggttacggggtaacggggtttccggggttttaagggggttcggtttaacccggggg

SEQ ID NO: 329710 - DNA, 683 bp, Homo sapiens
  misc_feature: GZ8MTXP01CIJHW.13.85.H08.1.454.CMB.2.raw
  modified_base (281)..(281): a, c, t, g, unknown or other
  misc_feature (281)..(281): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaacgtggtgcaatcgtgggctggaggtgacgaagccgtgggcctgagtgaagtcttcctgactaagtcatcgtgggtacacgtctccgaccacgaccactacntcgcgacgtcggtccgacgacggccccgtggacgtaacggtcgttaggaggtaggtagtacgggaactaagtccaacctacccgaagtccggtaggaggtcggtactcgaacccgtacgcgaacgtaaggttaaacggtttcggaagggacaagacgtaccaacagtacgaccgaacggaccaccgtaccgaacgaacgaacgaagtacgttagttaggaggttagacgtcacgccgtagacgtacgtacgtacggtaaccgaccgtaccggttaacgtttaacgttaaccgttggtaccgcgtaacgtaagttaaacgttacgttacgttaaccgaacgttaacgggtacgggttaacggggttcggggtttttaacggggttcgggtttaaccccggggg

SEQ ID NO: 329711 - DNA, 593 bp, Homo sapiens
  misc_feature: GZ8MTXP01BO3MH.13.85.H08.1.454.CMB.2.raw
  modified_base (240)..(240): a, c, t, g, unknown or other
  misc_feature (240)..(240): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcgagtgaagtctttccngcaagtcatcgtgggtacagcttcaccagccactacatgcacgtcgggtccgacgacggccccgtggctaaggtcgttggaggtggagtagggactaagtcactcccaagtggtgagtgggactcgaccctacgcaacgtagtaagttcgagggtacagacgtacacgagtacgaccgacgggaccaccggtaccaacgaacgaacgacgtacttagtttggaggttgagtcgagcctgagactcgtacgacgacgtacggttccgtttaatacgttgtgccgtagtaagacttattacgtcaacgtaacggtagggacgggtttcgggtttcggggttggtttaacccgggg

SEQ ID NO: 329712 - DNA, 718 bp, Homo sapiens
  misc_feature: GZ8MTXP01D7NGH.13.85.H08.1.454.CMB.2.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (554)..(554): a, c, t, g, unknown or other
  misc_feature (554)..(554): n is a, c, g, or t
  modified_base (568)..(568): a, c, t, g, unknown or other
  misc_feature (568)..(568): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcataccaggtacaactggtgcaatcgtggggctgaggtgacgaagcgtgggcctcgagtgagtctttctgacaagtcagtcgtagggtacncgtcttcaccacnccactacagtcgcacggtcggtaccgacgaccggtccccgtaggacgtaacggttcgttaggaggtaggtagttacggacttaaactaccgtaacctaccgtaaagttgggtacggtaagtcggggtactaccggtaacccgttaacgcgtaagtaaacgggttaacggtttacggaacgggacggtaacggtaactacccaaccgtaagtaccgggaaccgaacggggacctaaccggtaccgaacgtaacgaacgtaagtaacgttagtttggaagtggaacncgacgtctaaggtntaacgttccgaggtaacccgaccggttaccggttacctttaagtacgttggtcgttacggaacgtaagttaaacgttattaaccgggaacaacgtaacggggttacggggtaccggggttttgggtttcggggttaacgggttcccgggg

SEQ ID NO: 329713 - DNA, 547 bp, Homo sapiens
  misc_feature: GZ8MTXP01DUUD9.13.85.H08.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagcctgggcctnagtgaagtctttccngcaagtcatcgtgggacagtctcaccagcccaactacatgccacgtcgggtccgacgacggccccgtgggcaaggtcgttgaggtggagtaggactatcactccaagtggtacgagtggactgaccctacgcacgagtaagttcaggggcagtacgcacanagacaggacacgacanacganatacgtagttggaggttgagtcgacgcgtgagntacgngtacgacgtacgtccgttaatcgngtcgcgagagttattattgaactaacgaacgtgggtacggtttcgggttggggttcggttccgggg

SEQ ID NO: 329714 - DNA, 654 bp, Homo sapiens
  misc_feature: GZ8MTXP01ANKTB.13.85.H08.1.454.CMB.2.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagcgttggggcctnagtgaagtctttccngcaagtcagtcgtgggtacagcttaccaccacgccaactacatcgcacgtcgggtcccgaccgaccggcccccgtgggacgtaaggttcgttaggaggtggtagtcgggtaacttacgtccacctcccgtaagtggttgagtgggacctcgaacctacgcaacgtaggtaacggtttcgaggggtcaaggtaccgtacaccgagtacggaacccgacgggaccaccgtaccgagaacgaacaacgtacgtagtttaggagggttgagtcgagccgtagagacgtacgtcgaaccgtaccgtaccggttccgttttaagtccgttggtacgcggtacgaagttaacgttacgttaacgtaacgaacgtaacggtagggtacgggtttcggggtttgggggttaacggttcccgggg

SEQ ID NO: 329715 - DNA, 628 bp, Homo sapiens
  misc_feature: GZ8MTXP01C954T.13.85.H08.1.454.CMB.2.raw
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttccngcaagtcatcgtgggtacagcttcaccagccactacatcgcacgtcgggtccgacgacggccccgtgggcgaaggtcttggaggtggagtagggactaagtcacctccaagtcggtagagtgggactcgaccctacgcagtacgtagttcgagggcagactcacatcgaaccgaggaccacgaccgaacgacgaacagtactagtttaggagggttagagtacgagccgtagacgtagtaccgtaggtaaccgtacgtaccgggttccgttttaacttaacggttggttacggccgtacggtaagttaacgttaagttacgtaacgaaacgtaacggttacggggtaacgggtttcggggttttgggggttcgggtttaaccccggggg

SEQ ID NO: 329716 - DNA, 785 bp, Homo sapiens
  misc_feature: GZ8MTXP01B56VH.13.85.H08.1.454.CMB.2.raw
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgngggctggaggtgacgaagccgtggggcctcagtgaagtctttccngcaagtcatcgtgggtacagtcttcaccagcccactacatgcacgtcgggtacccgacgacggcccccgtagggacgtaacggttccttaggaggtgggagtacgggtaacttaactaccgaacctacccgaagttccggtaggagtgggacctcgacccgtacgcgaacgtaaggtaacgtttacggacgggacaaacgggacgtacctaacgaacgtacggaaccgaacggggaaccctaaccggtacccgaaacggaacgaaacccgaaggtaaacccgtttaggtttaacggggttaagggttacggtaacggtaccgaaacggcccgttaaggaacgggtaactaccggttacggaaacccggtaacccggttaaccgggtttacccggtttttaaacgtttaccggttacgggttaccggttaccggtaacgggtaacgttaagttaaacggttaacgtttaaacgaaccgttaacgggttaacggggtaacccggggttttgggggttttcggggggttaacggggttttcccccggggg

SEQ ID NO: 329717 - DNA, 648 bp, Homo sapiens
  misc_feature: GZ8MTXP01BGUVU.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaagtcgtgggctggaggtgacgagccgtggggcctgagtgaagtctttcctgacaagtcatcgtgggtacagctcaccagccactacatcgcacgtcggtccacgacggccccgtggacaaggtcgtagaggtggagtggtactactccactccaagtcggtagagtcgggactcgaccctacgcacgagtacgttcgaggtcagacgtcacgagtcgaccgagggactaccgtacgaacgagaaacgtacgtaacgttagttagggaggttcggagtaccgacgtaccgttagaccgtagttaccgtacggtaacccgtacggtacccggtttaccggtttaattaccggttggtccggaccggacggtaagttaaaccgttagttacggtaaccgtaagtaaccgggttagggtaacggggtttcggggttttaacgggggttcgggtttaacccgggg

SEQ ID NO: 329718 - DNA, 588 bp, Homo sapiens
  misc_feature: GZ8MTXP01CK9W6.13.85.H08.1.454.CMB.2.raw
  modified_base (373)..(373): a, c, t, g, unknown or other
  misc_feature (373)..(373): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttcctgcaagtcatcgtgggtacagtctcaccagccactacatgctacgtcggtccgacgacggccccgtgggactaaggtctaggagtggagtaggaactatccactccaagtggtgagtggactcggacctacgcanagtaagttcgaggcgagacgtcacagtcgacgaggacacgtacacgacgaacacgattagttggaggttgagtacagtccgagagataccggtagaaccggtacgttaaccggtccttttaagttccgttggtacggcgaacgtagttaacttaagttacgaacaacgtaacggttagggtaccgggtttgggtttggggttcggtttaaccggg

SEQ ID NO: 329719 - DNA, 702 bp, Homo sapiens
  misc_feature: GZ8MTXP01C3QVL.13.85.H08.1.454.CMB.2.raw
  modified_base (260)..(260): a, c, t, g, unknown or other
  misc_feature (260)..(260): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctggaggtgacgaagccgtgggctcgagtgaagtctttcctgactaagtcagtcgtagggtacngtctcaccagccactacatcgcacgtcggtccgacgaccggcccgtggacgtaacggttcgttaggacggtggacgtagggaactaactccgaacctaccgaagttccgggtaggtaacggtcgggtaaccgtcgaaacccgttaacggccgtaaacgtaaacgggttaaaggtttaccggaagggggacaacggtacgtacccgaacgtacggtaccggaaccgaacgggacccgaaccggtaccgaacgaaacgaacagtaacgttagttaggtagggtagagtacacgtcgtagacgtagttccgaacgaccgtaacgtaccggttagtttaacttacgttgtcggcgtaacgtaagttaaattacgttacgtaaccgtaacgtaacggttacgggttacgggtttacggggtttttcgggggcggttttaacccgggg

SEQ ID NO: 329720 - DNA, 677 bp, Homo sapiens
  misc_feature: GZ8MTXP01A3PR5.13.85.H08.1.454.CMB.2.raw
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctgagtgaagtcttttcngtcaagtcatcgtagggtacagtccttcaccagccactacatcgcacgtcgggtccacgaccggccccgtagggacaaggttcgttaggacggtagggagttagggaacctaaatccgacctacccgtaagtcgggtagaggtcggtactcggaaccctagcgaaacgtacggtaacgtttcggagggcaacggacgtacccacacgtacggaaccggacgggaactaacccggtaccgaacggaaacgaacgtacgtaacgttagttttcgggaaggtttaggacgtacgacgtccgtgaacgtacgttacgacgtaccggtaaccgtcggtttaccgtttaagttacgttggtcgacgtagtaagaacgttacttacggaactaaccggaagttcggggtacggtttcggggtttcggggttaagggttccccggg

SEQ ID NO: 329721 - DNA, 627 bp, Homo sapiens
  misc_feature: GZ8MTXP01D5DQB.13.85.H08.1.454.CMB.2.raw
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgaaggccgtggggcctcagtgaagcttttccngcaagtcatcgtgggtacagcttcaccagcccactacatgcacgtgggtccgacacgggccccctgggcaaggtcttggaggtggatggggactaatccactcccaagtcggtagagtgggactcgaccctacgcacgagtaacgtttcgaggggcagtacgtacacgatacggaccgagggaacccaacggtaccaacggaagaacagacttagtttgggaggtttgagacacgccgtgacgtagtaccgtaggaaccgtaccgtaccggtccgttttaattaaccgttggttcggcgtacggtaagttaagttaagttacgtaaccaaccgtaacgttcggggtaacggggttcgggttttaagggggttcgggtttaacccgggg

SEQ ID NO: 329722 - DNA, 616 bp, Homo sapiens
  misc_feature: GZ8MTXP01CW75R.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcgagtgaagtctttcctgcaagtcatcgtagggtacacgcttcaccagccactacatgcacgtcgggtccgacgacggccccgtgggacaaggtcttaggacgtggagtgggactaatcacctaccgaagtcggtagagtggggacctcgaacctacgcacgtaagtaagttcgagggacagacgtcacagtacgacgacggaactacgaccgaagaacgaacagtaacgtagttaggagttacggagacacggtcctagagtactacgtacgaccgaaccgtaccgttacgtttaagtacgttggtagccggagtaagttaagttagttacgctaacgtaacggttacggggtacggggtttcgggtttcgggggttcgggttaacccgggg

SEQ ID NO: 329723 - DNA, 677 bp, Homo sapiens
  misc_feature: GZ8MTXP01DTRUM.13.85.H08.1.454.CMB.2.raw
  modified_base (236)..(236): a, c, t, g, unknown or other
  misc_feature (236)..(236): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtcttttcngcaagtcatcgtgggtacagcttcaccagccactacatgcacgtggtccgacgacggcccctggcaaggtcttgagtgagtggactatcactccaagtcggagagtgggactcgacctacgcgaacgaaggtaacgtttcgaggggtcaaggtacgtacctaacccaagtacggaaccgaacggggtaacaaccggttacccgaacggaacgaaacccgaagtaaccgttaaagtttcgggaacggtttaggacggacgtacggacccgttaggacggtacttaccgttacggaaaccgtaccgtaaccgggttacccgttttaagtaaccgttggttacgaccggaacggtaacggttaaacttaagttacgtaaccgtaaacgtaacgttacggggtaacgggttccgggttttaaggggttcgggtttaacccggggg

SEQ ID NO: 329724 - DNA, 683 bp, Homo sapiens
  misc_feature: GZ8MTXP01DSQGZ.13.85.H08.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgagccgtgggcctnagtgaagtctttccngcaagtcatcgtgggtacagcttcaccagccactacatcgctacgtcgggtaccgacgaccggccccgtgggacctaaagggttccttggaacggttggggtaacgttacgggggtaaccttaaacgttccaacccgttaccccgaaaggtttggggtacggtaagtcggggtaactcggaacccttaaccgcgaaacgtaaggtaacgtttacgaacggggtcagacgtaccactagcgaaccgagggaccacgtaccgaagacgaacgagtacttagttaggagttgagtacacgcgtagagtactcgtagaaccgtacgtaccggttactttaagtcgttcggtcgaccgtagtaagttaacttaagttacggtaactaaaccgtaacggttacgggggtaacggtttcgggggtttttcgggggttcgggttttaacccggggg

SEQ ID NO: 329725 - DNA, 657 bp, Homo sapiens
  misc_feature: GZ8MTXP01AV0XP.13.85.H08.1.454.CMB.2.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (490)..(490): a, c, t, g, unknown or other
  misc_feature (490)..(490): n is a, c, g, or t
  modified_base (584)..(584): a, c, t, g, unknown or other
  misc_feature (584)..(584): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctgaggtgacgaagccgtggggcctcgagtgaagtctttccngacaagtcatcgtgggtacagtcttcgaccngcccactacatgccacgtcgggtcccgacgacggcccccgtgggaccgaaggttcgtttggaggtcggagtacgggtaactaacgtccacgtacccaagttccggtagaggtcggggactcgtacccgtacgcgaaccgtaaggttaacgtttcgacggggtcaacgtacgtaccgaccgtaaggacgaccgaacgggaccaccgaccgaagaacgaaacncgtaattaggtttaggtaggttaggagccgaacgtccgtagtacgtattacgagaccggacgtaccggttactttaagtaccgttggtcgacgngtaagttaattagttacgtaacacgaacggttcgggtaacgggttcgggtttcggggttcggtttaacccggg

SEQ ID NO: 329726 - DNA, 636 bp, Homo sapiens
  misc_feature: GZ8MTXP01EZRPT.13.85.H08.1.454.CMB.2.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctggaggtgacgaagccgtgggcctnagtgaagtctttcngctaagtcatcgtgggtacagtcttacaccagcccacacagtgccacgtcgggtcccacgacggccccgtggctaaggtctagngtgagtggactatcactccaagtcggtagagtgggactcgtaaccctacgcaaacgaaggtacgtttcgagggacagtacggtaccaacgagtacgaccgacgggaccgtacgaccgaaggaacaaccgagtaacttagttagggaggttagagacgacggtccgtggacgtagtacgtacggaaccgtacggtaccggttacgtttaacgtacgttggtcgacggaagtaagttaacgttaaagttcgtaacgtaacgtaacgggttcggggtaacggggttcggggttttgggggttaaccgggtttcccgggg

SEQ ID NO: 329727 - DNA, 635 bp, Homo sapiens
  misc_feature: GZ8MTXP01AV40U.13.85.H08.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctgaggtgacgaagccgtgggcctnagtgaagtctttccngcaagtcatcgtgggacagcttcaccagccactacatgcacgtgggtccacgacggccccctgggacaagggtcttggagtgggatgggactaatcgacctaccaagtggtgagtgggactgaccctagcacgtagtagttcgaaggggcagggtactacaaccgagtacgaacccggaagggaccgtaaccggtaccgaacggaagaaacccgaagtaaccgttagtttagggaggtttaggacgtccgaacggtccctggaaacggtcttaccgaggaccggtaacgtaaccgggttcccggtttaaatcccgttggtcgacggttacgaagttattaaacgttcgtaaccacgtaacgtacgggtacgggttcggtttgggggttcgttcccgggg

SEQ ID NO: 329728 - DNA, 641 bp, Homo sapiens
  misc_feature: GZ8MTXP01AS5TJ.13.85.H08.1.454.CMB.2.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctggaggtgacgaagccgtgggcctnagtgaacgtctttccngcaagtcatcgtgggacagtcttcaccacgccactacatgcacgtcgggtaccgacgaccggccccgtgggacgtaacggttcgttaggaggtggagtacgggtactaacgtccactacccgtaagtcggtagagtggactcgaacctacgcacgtagtacgttcgagggcagactcacagtacgacgaggactacgacaagacgaacagtacttagttaggaggttagagtacgacgtaccgtagagtacgtaccgtacggtaaccggtaccggttaccggttccgtttaagttaccgttggtacgacggtacgtaagttaacgttaacgttactaaccgaaacgtaacggttagggtaaccggggtttcggggttttaacgggggttcggttaaccccggg

SEQ ID NO: 329729 - DNA, 670 bp, Homo sapiens
  misc_feature: GZ8MTXP01CB8Z5.13.85.H08.1.454.CMB.2.raw
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctgagtgaagtcttccngcaagtcatcgtggtacagcttcgacagccacanatgcacgtgggtccgacacggccccgtggacgaggtcttggagtggagtggactatccgaactcccgaagtcggngagtggtacncgacccgtacgcaaagagtaaggttcgacgggacagacgtcacgagtacgacgaggacacgtcgaacgagaacgacgtacgttagttagggtaggttaggaacggacgtacggaccgttaggaaagtcgttacgtacggtaaccggtaaccgtaaccgggttcccgtttttaaacgtaacggtttcgggcgggttacgtaaccggggaattaaacgttacgttaaacgtcccgtaaaacgttaaccgggttaacgggggtacggggttttaccgggggtttttaagggggttccggggttttaaccccggggg

SEQ ID NO: 329730 - DNA, 599 bp, Homo sapiens
  misc_feature: GZ8MTXP01EZYQK.13.85.H08.1.454.CMB.2.raw
  modified_base (239)..(239): a, c, t, g, unknown or other
  misc_feature (239)..(239): n is a, c, g, or t
  modified_base (349)..(349): a, c, t, g, unknown or other
  misc_feature (349)..(349): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttccngcaagtcatcgtgggtacagcttcaccagccactacatcgcgacgtcgggtccgacgacggccccgtggacaaggtctggagtggatggactagtcactaccaagtcggngagtgggactcgacccacgcacgtagtagttcgagggtcagtacgtcacgntacgacgacggacaccgtacacgganaacgacgtacttagttcggaggttgagcacgcctgagtntacgtcgacgtaccgtcggttcgtttaattcgttggtcgttaccggagtaaggttaacttaacgttacgtaaccaacgtaacggttcgggtaaccgggtttgggttttaacgggggttcgggtttaacccgggg

SEQ ID NO: 329731 - DNA, 680 bp, Homo sapiens
  misc_feature: GZ8MTXP01AWSL4.13.85.H08.1.454.CMB.2.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagtctttccngcaagtcatcgtgggtacngcttcaccagccactacatcgcacgtcggtccacgacggccccgtggactaaggtcttggaggtggagtcgggacttagtccacgtacccgagtcggtcgagttcggacctcgaaccctacgcacgtagtaagttcgagggtcaaggtacgtacacctagtacgaacgacgggaccaccggtacgaacggaacgaacgagtacttaggttgggaacggtttaggacgtcgtacggtccgtagacgtacgtaccgtacggaaccgtaccgttaaccgggttccgttttaagtaaccggttcggtacggttcggtaaaccggtaagttaaacgtttacgttaacggtaaccctaaacggttaaccgggttacgggggtaacccgggtttgggggttttcgggggttcggggttttaaccccgggg

SEQ ID NO: 329732 - DNA, 623 bp, Homo sapiens
  misc_feature: GZ8MTXP01CVRZ0.13.85.H08.1.454.CMB.2.raw
  modified_base (237)..(237): a, c, t, g, unknown or other
  misc_feature (237)..(237): n is a, c, g, or t
  modified_base (561)..(561): a, c, t, g, unknown or other
  misc_feature (561)..(561): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgagcctggggcctcagtgaagtctttccngcaagtcagtcgtggtacagcttcaccagccactacatgccacgtcgggtcccgacgacggcccccgtgggacaagggtccttggacggtggagttgggacttaagtcctaacctcctaagtccggtagaggtcgggactcggaacccttacgccgtaacgacggttaagtttcggagggtacaggtacgtaccaaccagtacggaccgaacggggaaccaccgaccgaacgaacgaaacgacgtaacgttagtttagggaggtttcgaagtcgacgtccgtgaggatcgtagacgacgtcggtctttaatcgttgtcgcgagngattagttacgtaacaacgtcggtacggtaccgggttgggtttcggggttggttaaccgggg

SEQ ID NO: 329733 - DNA, 898 bp, Homo sapiens
  misc_feature: GZ8MTXP01AE051.13.85.H08.1.454.CMB.2.raw
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtnttcatacccaggtacaacgtggtgacaatcgtgggntgaggtgacgagccgtgggctgagtgagtctttccngactaagtcagtcgtagggtacagtcttacaccagaccccaactacagtcgccgtacgtcgggtacccgacgaccgggtccccgtgggacgtaacggttccgttaggacgggttaggggaacggttacgggggtaaaccttaacgtacccgtaaacccgttacccccgtaaagggtttaccggggtggtaacgggttcgggggacccttaccggtaaccccgttaaacccgggaacccgtaaacgggtaaaccgggtttaaaccggttttaccggggtaacgggggaccgtaaaggggtaacccgttaccccgaaaacccgtaaggttaacccggggaaaccccggaaaccgggggaacccgtaaccccggtaaccccggaaaaccggtaaaccggaaaaccgtaaaccgttaaaccggttttaacggtttagggggtaaaccggggtttacggaacggggttaccgaacgggttacccgtaaggtaacgacggtttacccgtaaccgggaccggtaaacccgttacgggtttaccccgttttaaattccgggttagtacccggttacggaacgtaacgttaacttaaacgttacgtaaccgtaacgtaacgtacgggggttacggtttcgggggttttcgggttcggggtttaaccccgggg

SEQ ID NO: 329734 - DNA, 726 bp, Homo sapiens
  misc_feature: GZ8MTXP01AO20N.13.85.H08.1.454.CMB.2.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaacgtggtgcaatcgnggggctggaggtgacgagccgtgggcctgagtgaagtctttcngacagtcattcgtagggtacagtccttacaccgacgccctaactacacgtcgcgacgtcggggtcccaacggaccggccccgtgggacctaaggtcgttaggaggtgggaagtcggtaactactccgactcccgtaagtcgggtagtaggtacgggactccggaacctacggaactaacgaacggttaaagttccggagggactagactaccgaacagtacggacggacggacgtaaccgccgaaagacgaacgaacgttacgttagttagggacgttacggagccgacggcgtaggactacggttaccacgggtaacccggtacgtaaccggggtttaccctttaagttaaccgggttggtcccggacggtaagggtaaccttaagggtttaaaccaacgggtaaccctaagggttaacccggggttaagggggttaaccccgggggttttgggggtttcggggttcggggggtttaaccccccgggg

SEQ ID NO: 329735 - DNA, 523 bp, Homo sapiens
  misc_feature: GZ8MTXP02GUKK8.13.85.H08.1.454.CMB.2.raw
  modified_base (433)..(433): a, c, t, g, unknown or other
  misc_feature (433)..(433): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctggggtacagcttcaccagccactacatgcactgggtccgacaggcccctgggcaaggtctgagtggatgggactaatcactcccaatcggtgatgggactgcctacgcacagagttcaggggcagagtcaccatgaccagggacacgtccacgacgaacagactagttggagttgagcagcctgagntctgacgacacggtccgtttatacgtgtacgcggcgagataagtagtcaacaacgtcggaaacggtcggttttcgggggtggtttccggg

SEQ ID NO: 329736 - DNA, 538 bp, Homo sapiens
  misc_feature: GZ8MTXP02GU303.13.85.H08.1.454.CMB.2.raw
  modified_base (492)..(492): a, c, t, g, unknown or other
  misc_feature (492)..(492): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagctttcctgcaagtcatctgggtacagcttcaccagccactacatgcacgtgggtcccgacgacggccccgtgggccaaggtcttggagtggagtgggactaatcacctcccaatcggtgagtgggactgccctacgcacagtaacgtttcgagggcagacgtacaccagtcgacgagggacacgtccagaacgacagactagttggagttgagcaggcctagagtatcgtagacgacgacggtccgtttatacgtgtcgcgngagatagtatcgaacacgtcggacggtcggtttggggtcggttcgg

SEQ ID NO: 329737 - DNA, 513 bp, Homo sapiens
  misc_feature: GZ8MTXP02JMQHV.13.85.H08.1.454.CMB.2.raw
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtctgagtggatggggactaagtcactcccaatcggtgatgggactgcctacgcacagaagtttcagggcagagtcaccatgaccagggacacgtccacgagaacagactattggagttgagcagcctgagatctgacgacacggcgtttactactgtcgcgcgagataanagtcacgaacgtggaacggtcggtttaggggnggtttcggg

SEQ ID NO: 329738 - DNA, 519 bp, Homo sapiens
  misc_feature: GZ8MTXP02GF6TS.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactattggagttgagcagcctgagatcgtgacgacgacgtcgtttatacgtgtcgcgcgagtactaatagtaacacaacgtcgggaaacggtcggtttaggggtggtttcggg

SEQ ID NO: 329739 - DNA, 535 bp, Homo sapiens
  misc_feature: GZ8MTXP02G8FP6.13.85.H08.1.454.CMB.2.raw
  modified_base (408)..(408): a, c, t, g, unknown or other
  misc_feature (408)..(408): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctggggtacagcttcaccagcccactacatgcactggtccgacacggcccccgtgggcaaggtcttgagtggagtgggactagtcactcccaatggtgatggactggcctacgcacgagagtttcaggcagagtcacatcgacaggacacgtccacgagaacanactattgagttgagcagtcagagagtcgtagaccgacgtacggtacccgtttatacgtgtcgcgacggagataatagtcaaacgtaacgtacgggaacggttcgggtttgggggtcggtttccgggg

SEQ ID NO: 329740 - DNA, 509 bp, Homo sapiens
  misc_feature: GZ8MTXP02GJ0WX.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacacggcccctgggcaaggtctgagtggatgggactaatcactcccaatcggtgatgggactgcctacgcacagaagttcgagggcagagtcacatgacaggacacgtccacgagaacagactagttggagttgagtcagccagagatctgacgacgacgtcgtttatactgtcgcgcgagatatagtcacaacgtacggaacggtcggtttggggaggtttcgg

SEQ ID NO: 329741 - DNA, 512 bp, Homo sapiens
  misc_feature: GZ8MTXP02H8017.13.85.H08.1.454.CMB.2.raw
  modified_base (334)..(334): a, c, t, g, unknown or other
  misc_feature (334)..(334): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagcttcctgcaagtcatctgggtacagcttcaccagccactacatgcactggtccgacaggcccctgggcaaggtcttgagtggatgggactaatcactcccaatggngatgggactgcctacgctacagaagtttcaggggcagatcaccatgaccagggacacgtaccacgagaacagactaattggtagttgagcagcctagagatctgacgacacggtaccgtttatacgtgtcgcgcgagataaatgtaacacaacgtggaacgtcggtttgggtgtcggg

SEQ ID NO: 329742 - DNA, 536 bp, Homo sapiens
  misc_feature: GZ8MTXP02FTXGZ.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcacgtggtccgacacggcccctgggcaaggtctgagtggatgggactaatcactcccaatggtgatgggactgcctacgcacagtaagtttaggcagagtcaccatacgacgaggacacgtacacgagaacagactagttaggagttgagcagccgtagaagatcgtagaacgacgacggtacgtttatacgtgtcgacgcgaagataatagtacaacgaacgtacggaacggttggtttaggggtcggttcggttaccccgg

SEQ ID NO: 329743 - DNA, 548 bp, Homo sapiens
  misc_feature: GZ8MTXP02G9RO6.13.85.H08.1.454.CMB.2.raw
  modified_base (235)..(235): a, c, t, g, unknown or other
  misc_feature (235)..(235): n is a, c, g, or t
  modified_base (341)..(341): a, c, t, g, unknown or other
  misc_feature (341)..(341): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttccngcaagtcatctgggtacagcttcaccagccactacatgccacgtggtccgacacggcccctggggcaaggtcttggagtggatgggactaatcacctccaatggtnagtgggactgcctacgcacagaagttcagggcagagtcacatgaccagggacacgccaagagaacagactagtttggagttganctagcctgagntcngacgacgtacgccgttttacacgttggcgcggacgaggtataagttacgtaaccaacgtaaacgtcggggaaaaccggttcgggttttacgggggtaggtttaccgggg

SEQ ID NO: 329744 - DNA, 543 bp, Homo sapiens
  misc_feature: GZ8MTXP02HZLNY.13.85.H08.1.454.CMB.2.raw
  modified_base (237)..(237): a, c, t, g, unknown or other
  misc_feature (237)..(237): n is a, c, g, or t
  modified_base (488)..(488): a, c, t, g, unknown or other
  misc_feature (488)..(488): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttccngcaagtcatcgtgggtacagcttcaccagccactacatgcacgtgggtccacacggccccgtgggcaaggtcttgagtggatgggactaatcactccaatggtgagtggactgctacgcacagtacgttcgagggtcagtacgtcgaccagcgaccgaggtacacgtccagaagaacagactagttggattgagcagcctagagatcagtacgactacggtaccgtttatacgtgtcgcgacgagaataanacgtaacaacgtaacgtcggtaaacggtcgggttttagggggtcggtttccgggg

SEQ ID NO: 329745 - DNA, 532 bp, Homo sapiens
  misc_feature: GZ8MTXP02F3IK9.13.85.H08.1.454.CMB.2.raw
  modified_base (338)..(338): a, c, t, g, unknown or other
  misc_feature (338)..(338): n is a, c, g, or t
  modified_base (378)..(378): a, c, t, g, unknown or other
  misc_feature (378)..(378): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgatgaagcctggggcctcagtgaagctttcctgcaagtcatctgggtacagcttcaccagccactacatgcactgggtccgacagggccccctgggcaaggtcttgagtggatgggactaatcactccaatggtnatgggactgcctcgcacagagttcagggcagagtcaccangacagggacacgtcagagaacagactagttagagttgagacaggcctagagatcgtagaacgacgaaccggtccgtttagttactgtcgacgacgaagattaaagtaactacgaacgaacgtaggtaaaccggtcgggttttagggggttcggg

SEQ ID NO: 329746 - DNA, 538 bp, Homo sapiens
  misc_feature: GZ8MTXP02HQE7L.13.85.H08.1.454.CMB.2.raw
  modified_base (239)..(239): a, c, t, g, unknown or other
  misc_feature (239)..(239): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcgagtgaagtctttccngcaagtcatcgtgggtacagcttcaccagccactacatgcacgtgggtccgacgacggccccgtgggcaaggtcttggaggtggagtggggactaagtccacctcccaagtcggtagagtgggactgaccctacgccacaagtagtttcgagggcagacgtcacatcgacgagggacacgtaccagaagaacagactagttggagttgagcagcctagagatcgtacgacgacgacgtctttatcgtgtcgcganagatatagtcanacgtcggacggttcggtttgggtcggttcggg

SEQ ID NO: 329747 - DNA, 532 bp, Homo sapiens
  misc_feature: GZ8MTXP02G3WHK.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagcttcctgcaagtcatctggtacagcttcaccagccactacatgcacgtggtcccgacacggccccgtgggccaaggtcttgagtggagtgggactaatcactccaatcggtgatgggactgcctacgcacagtaagtttcaggggcagacgtcaccatcgacgaggacacgtccacgagaacagactagttggagttgagcagctagagatctgacgacgtacggtcctttagtacgtgtcgcgacgagtactaagtagtaacaacgaacgtaggaaccgtcggtttaggggtcgtttacgggg

SEQ ID NO: 329748 - DNA, 561 bp, Homo sapiens
  misc_feature: GZ8MTXP02HTUSO.13.85.H08.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctnagtgaagtctttccngcaagtcatcgtgggtacagcttcaccagccacacatcgcacgtcggggtccgacgacggcccccgtgggacaaggtctggagtggatggactaancacctccaagtcggngagtggactgcctacgcagagtagttcgagggcagagcacatcgacagggacacgtaccaacgagaacagtactagtttggagttgagcagcctagagtatctagacgacgtacggtaccgtttaagtactggtcgcggtacgaacgtaataagtacgtaacgaacgaaacgtcggggaaccggttcgggttttagggggtcggtttaccggg

SEQ ID NO: 329749 - DNA, 550 bp, Homo sapiens
  misc_feature: GZ8MTXP02JIR8I.13.85.H08.1.454.CMB.2.raw
tcagtcacgtactacacgaccggtgctcgatttagtatcactcagtcgcggggagcatcatccaacaacaacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagcttcctgcaagtcatctgggtacagcttcaccagccactacatgcacgtgggtaccgacgacggccccctgggcaaggtctggacggtggagtgggactaagtcactccaatcggtgatggactgcctacgcacagacgttcgagggcagacgtcacgatacgacgaggacacgtcaacgagaacagacttagttgagtgagcagcctagagatcgtgacgacaggtcctttaatacgtgtacgcgacgtagaacttaagtacgtaacgtaacgtaacgtacggggtaacgggttccggttttagggggacggtttccgggg

SEQ ID NO: 329750 - DNA, 517 bp, Homo sapiens
  misc_feature: GZ8MTXP02IZAMN.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacacggccccctgggcaaggtcttgagtggatgggactaatcactccaatggtgatgggactgcctacgcacagaagttcgaggggcaggagtcaccatgaccaggacacgtcacgagaacagactagttggagtgagcagcctgagatctagacgacgacggtccgtttatacgtgtcgcgacgagataatagtcacaacgtcggaacggtcggtttcgggggtgttacggg

SEQ ID NO: 329751 - DNA, 562 bp, Homo sapiens
  misc_feature: GZ8MTXP02IUU2L.13.85.H08.1.454.CMB.2.raw
  modified_base (235)..(235): a, c, t, g, unknown or other
  misc_feature (235)..(235): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttccngcaagtcatctgggtacagcttcaccagccactacatgcacgtcgggtccgacacggccccgtgggacaaggtcttgagtggatgggactatcactccaatcggtgatgggactgcctacgcacgagtaagttcgagggtacagagtcacatcgaccgagggacacgtccagacgaacagactagtttaggaggttagagtccgagtccctagacgagtcgtagacgacgtacggtccgtttaacgtactgtcggtcgacgtagtaactaatacgtaacaaacgtaacgtacgggtaaccggtcggtttagggggtcggtttccggg

SEQ ID NO: 329752 - DNA, 558 bp, Homo sapiens
  misc_feature: GZ8MTXP02G72RP.13.85.H08.1.454.CMB.2.raw
  modified_base (410)..(410): a, c, t, g, unknown or other
  misc_feature (410)..(410): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcacgtgggtcccgacacggcccctgggcaaggtctgagtgatgggactaagtcactcccaatcggtgagtgggactgaccctacgcacagtaagtttcgagggcagacgtcgaccatcgacgagggacacgccaganaacagactattggagtgagcagcctagagactcgtagacgacgacggtaccgtttaactacgttgtcggacgacggaagtaacgtaataggtaacaacgtaacggtacggaacgggttcgggttttagggggtacggtttacccgggg

SEQ ID NO: 329753 - DNA, 532 bp, Homo sapiens
  misc_feature: GZ8MTXP02HXKQV.13.85.H08.1.454.CMB.2.raw
  modified_base (235)..(235): a, c, t, g, unknown or other
  misc_feature (235)..(235): n is a, c, g, or t
  modified_base (327)..(327): a, c, t, g, unknown or other
  misc_feature (327)..(327): n is a, c, g, or t
  modified_base (482)..(482): a, c, t, g, unknown or other
  misc_feature (482)..(482): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttccngcaagtcatcgtgggtacagcttcaccagccactacatgcactgggtccgacacggccccctgggccaaggtcttgagtggatgggactaancactcccaatggtgatgggactgcctagcacagagtttcgagggcagagtcaccatgaccgaggacacgtaccacgagaaccagactagttggattcgagcagcctgagatctagacgacacggtccgtttatacgtgtcgcgacgacgtataanacgtaacaccgaacgtacggaaaggtcggtttacggggtggtttacgggg

SEQ ID NO: 329754 - DNA, 650 bp, Homo sapiens
  misc_feature: GZ8MTXP02F43D5.13.85.H08.1.454.CMB.2.raw
  modified_base (346)..(346): a, c, t, g, unknown or other
  misc_feature (346)..(346): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttcctgcaagtcatcgtggtacagtcttcaccagcccactacatgccaacgtcggggtccgacgacggcccccgtgggacctaagggtcttggaggtggagtgggacttaanccacctacccgaagtcggtgagtggggactcggccctacgccaacgagtaaggtttcgagggcagacgtaccacacgtacggaaccgacgggaaccctaccggacccgaacggaacgaacgaacgtaacttaagtttacggggagtttacggagccgtagtccgaggtagacgttcgtacggaaccgaccggtacggtaccttttaacgttacgttggtacggcgtacggacgtaaattacgtaagtccgaaacgtaacgtacgggtaaccggggtttggtttacgggggtggtttacccgggg

SEQ ID NO: 329755 - DNA, 595 bp, Homo sapiens
  misc_feature: GZ8MTXP02JW55O.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttcctgcaagtcatctgggtacagcttcaccagccactacatcgcacgtcgggtcccgacgacggcccccgtgggacaaggtctggagtggagtggactatcactccaagtcggtgagtgggactcgacctacgcacgagtaagttcgagggtcagacgtacaccatcgaccgaggacacgaccacgaagaacagacttagttaggagttgagtcgacgctagagtacgtacgtaggaccgacgtaccggttacgtttacgttacgtggtcggtacggacgtaacgtaacttaagtacgtaacaaaccgtaacggtacgggtaacgggtttcggggttttacgggggtcgggtttacccgggg

SEQ ID NO: 329756 - DNA, 587 bp, Homo sapiens
  misc_feature: GZ8MTXP02HHZ14.13.85.H08.1.454.CMB.2.raw
  modified_base (464)..(464): a, c, t, g, unknown or other
  misc_feature (464)..(464): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgaagccgtggggcctcagtgaagtctttcctgcaagtcatcgtgggtacagcttcaccagccactacatgcacgtcgggtcccgacgacggccccgtgggactaacggtcttgagtggagtgggactaatccactacccaatcggtgagtgggactgcctacgcacagtaagttcgagggcagcgtacacatcgacgaggaccacgtccgaacgaacgaacagacttagttgggtaagttgagcgacgtccgtaganacgtcgtacggaccgtacgacggtaccgttttacgtacgtggtcgacgacggaacgtactaagtacgaaccgaactaacggtacgggtaacggttcgggtttacgggggtcggtttaccgggg

SEQ ID NO: 329757 - DNA, 579 bp, Homo sapiens
  misc_feature: GZ8MTXP02G1WXF.13.85.H08.1.454.CMB.2.raw
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgctgctggctgtagctccaggtgttcatacccaggtacaactggtgcaatcgtggggctggaggtgacgaagccgtggggcctcgagtgaagtctttccngcaagtcatcgtggtacagctcacacgccactacatgcacgtcggtaccgacgacggccccgtggacgaaggttcgtgagtggagtggactaatcactaccgtaagtcggtagagtgggactcgacctacgcaacgtaagtaacgtttaccgagggacaaggtacgtaccaacagtacgaacgacggaaccacgaccgaacgaaagaaccagtaattagttggagttagagcgagcctagagatcgacgacgacgtacgtccgtttaatcgtagtcgacgagacgaataagtataacgaacgaacggtacggaaggttcggtttggggtaggtacccggg

SEQ ID NO: 329758 - DNA, 561 bp, Homo sapiens
  misc_feature: GZ8MTXP02HK8RU.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagcttctgcaagtcatctggtacagcttcaccagccactacatgcactggtccgacacggccccgtgggcaaggtcttgagtggatgggactaatcactccaagtggtgagtgggactgcctacgcacaagtaacgtttcgaggggtcagagtcaccatagaccagggacacgtccacgaagaacagacttaagttggagttgagtcgagcctgagtactcgtaggaccgacgtacggtacgtttacgttactggtcgacggacgacgtaactaagtagtaaccaacgtaacgtacgggtaacggttacggtttgggggttacggtttaccgggg

SEQ ID NO: 329759 - DNA, 539 bp, Homo sapiens
  misc_feature: GZ8MTXP02FUP8R.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctgggggcctcagtgaagctttcctgcaagtcatctgggtacagcttcaccagccactacatgcactgggtccgacaggccccctgggcaaggtcttgagtggatgggactaatcactcccaatggtgatgggactgcctacgcacagaagttcagggcagagtcacatgacaggacacgtccacgagaacagactagttgagttgagcagcctagagatcgtagacgacacggtcgtttaattaccgtagtcgacgacgtacgtaactaagtacgtaacaacgaaacgtacggggaaacggtcggttttgggggtaggtttccgggg

SEQ ID NO: 329760 - DNA, 556 bp, Homo sapiens
  misc_feature: GZ8MTXP02GPNWP.13.85.H08.1.454.CMB.2.raw
  modified_base (243)..(243): a, c, t, g, unknown or other
  misc_feature (243)..(243): n is a, c, g, or t
  modified_base (344)..(344): a, c, t, g, unknown or other
  misc_feature (344)..(344): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggaggatcctcttcttggtggcaacagccacaggagcccactcccaggtgcagctggtgcagtctggggctgaggtgaagagcctggggcctcagtgaaggtctcctgcaagcctntggatacaccgtcaccgacgaccatatatactgggtgcgacaggcccctggacaaggccttgagtggatgggacatatcagccctgtcccagtggtgccanaaagtttgcacagtaactttcgagacagggtcacatcgaccacggacacgtcagtcaacacacgcctaacagtacggaactaggaggagacccgtaaagactacgtagaaccgacgtaccgggtaccgttttattagttcgtagactaaagtaacgtaattaggaacaaacgtaagtcgtacttttagagttagtcggttacggggaaccgg

SEQ ID NO: 329761 - DNA, 592 bp, Homo sapiens
  misc_feature: GZ8MTXP02H4T6T.13.85.H08.1.454.CMB.2.raw
  modified_base (239)..(239): a, c, t, g, unknown or other
  misc_feature (239)..(239): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagtctttccngcaagtcatcgtgggtacagcttcacacgccactacatcgcacgtcggtccgacgacggccccgtgggcaaggtcgttgagtggagtgggactaatccactaccaagtggtagagtggacttcgcctacgcacgagtacgttcgaggtcagacgtccacgatacgacgaggacacgtaccacgagaacgagacttagttaggagttgagcgagcctagagcgtacgagacgacgaccggttacgtttagtacgttggtcgacggacgtaacgaattaacgtacgtaaccgtaacgtaaacggttacgggtaaacgggtttccggggttttagggggttacgggtttcccgggg

SEQ ID NO: 329762 - DNA, 588 bp, Homo sapiens
  misc_feature: GZ8MTXP02H7HME.13.85.H08.1.454.CMB.2.raw
  modified_base (237)..(237): a, c, t, g, unknown or other
  misc_feature (237)..(237): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttccngcaagtcatctgggtacagcttcaccagccactacatgcacgtgggtcccganacggcccccgtggcaaggtctgagtggatgggataancactcccaagtcggtgagtgggactgccttacgcacagtacgtttcgagggtcagagtcaccatcgacgagggacacactaccacgaacgacagacttagtttaggagttgacgcacgccgtagacgtatacgtcgacgtacgtacccgggttaccgttttacgtttaccgttggttacggacgtacgaacgtaagttaataacgttacgaaacgtaacgtacgggtaacgggttcgggtttttacgggggtttaccgggg

SEQ ID NO: 329763 - DNA, 608 bp, Homo sapiens
  misc_feature: GZ8MTXP02ICGQM.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctgagtgaagtctttcctgcaagtcatcgtgggtacagcttcaccagccactacatgcacgtcgggtccgacgacggcccccgtgggctaaggtctggagtggatgggactatcactccaagtggtgagtgggactgccctacgcacgagtagttcgaggggtcagacgtacacgagtacgaccgaaggggaccaccgtaccaacgaagaaacgagtacttaagtttggagttgagacagccgtgagtatcgtacggaaccgaccgtaccggttacgttttacgtacgttggtacgcggaacgtaacgtacgttaaatacggtaaccaacgtaaacggttacgggaaacccgggtttgggttttacgggggtcggtttacccggggg

SEQ ID NO: 329764 - DNA, 513 bp, Homo sapiens
  misc_feature: GZ8MTXP02FF2SV.13.85.H08.1.454.CMB.2.raw
  modified_base (426)..(426): a, c, t, g, unknown or other
  misc_feature (426)..(426): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtctgagtggatgggactaatcactcccaatcggtgatgggactggcctagcacagaagtttcgaggcagagtcacatgacagggacacgtccagagaacagactagtttggagttgagcagccngagatcgtgacgacacggccgtttatactgtagcgcgagataatagtaacacaacgtcggaacggtcggtttaggggtggttacggg

SEQ ID NO: 329765 - DNA, 509 bp, Homo sapiens
  misc_feature: GZ8MTXP02FIUCI.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctgggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactattgagttgagcagcctgagatctgacgacacggtccgtttatactgtcgcgcgagataatagtaacacaactggaacggtcggtttaggggtggttcggg

SEQ ID NO: 329766 - DNA, 642 bp, Homo sapiens
  misc_feature: GZ8MTXP02HGZGH.13.85.H08.1.454.CMB.2.raw
  modified_base (238)..(238): a, c, t, g, unknown or other
  misc_feature (238)..(238): n is a, c, g, or t
  modified_base (344)..(344): a, c, t, g, unknown or other
  misc_feature (344)..(344): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcgagtgaagtctttccngcaagtcatcgtgggtacagcttcaccagccactacatgcacgtcgggtccgacgacggccccgtgggcaaggtctgagtggagtggactagtcactccgaatggngatgggactggcctagcacagtagttcgaggcagagtcacatacgacgaggaccacgtaccacggaacgaaacaggtaccttaaggtttggtaaggttagacgacgacggtaccgtggacgtaacgttcgtacggaccgtaaccgtaaccggttacccggttttaaattaccgttgggtacggacccggacgtaaaggtaactttaaacgtacgtaacccgtaaaacgtaacccggttaagggggtaaacccggggtttcgggggtttttaacggggggtacggggtttacccggggg

SEQ ID NO: 329767 - DNA, 556 bp, Homo sapiens
  misc_feature: GZ8MTXP02GTMBQ.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagtcctggggcctcagtgaagctttcctgcaagtcatcgtgggtacagcttcaccagccactacatgcactgggtccgacacggcccctggcaaggtctgagtggatgggactaagtcactccaatggtgagtggactgcctacgcacgagtaagtttcgagggtcagacgtcactagcgacgaggactacgaccacgagaacagacttagttggagttgagtcagcctagagatacgtacgacgacgacgggtcctttaagtacgtgtcggcgacgaggtaactaagtacggtaaccaacgtaacgtacgggaacgggttccggtttagggggtacggtttccgggg

SEQ ID NO: 329768 - DNA, 576 bp, Homo sapiens
  misc_feature: GZ8MTXP02G1PQZ.13.85.H08.1.454.CMB.2.raw
  modified_base (321)..(321): a, c, t, g, unknown or other
  misc_feature (321)..(321): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttcctgcaagtcatctgggtacagcttcaccagccactacatgcacgtcgggtccgacgacggcccccgtggggacaacgggtcttggnggtggagttggggacttaagtccacctccctaaatcggtgagtgggactgcctacgcacagtaacgttgagggcagacgtacaccatcgacgaggacacgtccgacgaagaacagacttagttaggagttgagtcgagcctagagactcgtagacgacgacggtcctttacgtacgtggtcgcgacgaggactaagtaggtaaccacgaacgtaggggaacggttcgggttttacgggggtcggtttacccgggg

SEQ ID NO: 329769 - DNA, 556 bp, Homo sapiens
  misc_feature: GZ8MTXP02GDFJO.13.85.H08.1.454.CMB.2.raw
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttccngcaagtcatctgggtacagcttcaccagccactacatgcacgtgggtccacgacggccccgtgggacaaggtctgagtggatgggactaatcactaccaagtcggtagagtggactgcctacgcanagtagttcgagggcagactacacatcgacgaggacacgccagaagaacagtactagttgagttgagacgacgctagagatacgtagaccgacgtacggtacgtttaactacgtgtcggtacgacgaagtaattaactaggtaaccaacgtaacgtacgggtaacggttcggtttagggggtacggtttaccggg

SEQ ID NO: 329770 - DNA, 531 bp, Homo sapiens
  misc_feature: GZ8MTXP02H37YZ.13.85.H08.1.454.CMB.2.raw
  modified_base (232)..(232): a, c, t, g, unknown or other
  misc_feature (232)..(232): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctgggcctcagtgaagcttcngcaagtcatctgggtacagcttcaccagccactacatgcactggtccacaggcccctgggcaaggtcttgagtggatgggactaatcactccaatcggtgatgggactgcctacgcgacagtaagttcgaggtcagagtcacatgacaggacacgtaccacgagaacagtactagtttaggagttgagtacagcctagagattcgagacgacgacggtaccgtttatacgtgtcgacgcgtagacttaaatacgtaacaacgaaacgtcggaacggttccggtttgggtaggttccggg

SEQ ID NO: 329771 - DNA, 702 bp, Homo sapiens
  misc_feature: GZ8MTXP02I7SXV.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgacaagtcatcgtgggtacagcttcaccagccactacatgcacgtgggtccacgacggcccctgggcaaggtcttggagtggagtgggactagcactccaatcggtagagtggactcgaccttacgcaacaggtaacgtttacgagggaccaggtacgtaccgaccagtacgaaccgaggggaaccaccgtacccgaaacgaacgaaacacggtaacctttaaggtttagggtaagtttacggaggaccgtaacgggtaccccgttaaggaagtacgtttaccgtacggaaacccggtaaccgtaaccggggttaaccccgtttttaagttaaacccggttaggttccggaccggttaccggaacggttaaaaccttaagttaaacggttcccaaaacgttaaccggttaacggggtaaaccggggtttccgggtttttagggggttaacggttttacccccggggg

SEQ ID NO: 329772 - DNA, 604 bp, Homo sapiens
  misc_feature: GZ8MTXP02F8W24.13.85.H08.1.454.CMB.2.raw
  modified_base (266)..(266): a, c, t, g, unknown or other
  misc_feature (266)..(266): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcgagtgaagtctttcctgcaagtcatcgtggtacagcttcaccngccactacatgcacgtggtccgactacggccccgtgggccaaggtcttgagtggatgggactatcactaccaagtcggtcgagtggactgccctacgcactagtaacgttcgagggtacgagcgtacacgtatacgaccgagggtaaccacgaccgaacgaacgaacgtacgactttaaggttggaggttagacgcgtacgcctagaagtcacgtacgacgaacgtcggttaacccgtttattacgtcggtagaccgtacggaactaagtaacgtacggtaacaaacgtacggtaacgggtaacggtttccgggtttaggggtcggtttaacccgggg

SEQ ID NO: 329773 - DNA, 648 bp, Homo sapiens
  misc_feature: GZ8MTXP02GIJQ8.13.85.H08.1.454.CMB.2.raw
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtcttttcngcaagtcatcgtgggtacagcttcaccngccactacatcgcacgtgggtccgacgacggccccgtgggactaacggtctagagtggagtgggactaagtccactcccaagtcggtagagtggactcgacctacgcactagtaacgtttcgagggacagactacacgagtcgaacgaggaccacgtaccgaacgagaaacgacgtaacgtttagttggtagttacggagtaccgtaggcccgtagaacgtataccgtacggacccgtaacggacccgggtttacccttttaacggttacgtggttaccggaccgggacgaaacggttaacgtaaacgttacgtaaccgaacgtaacggttacgggggtaaaccgggtttcgggggtttagggggttcgggtttacccggggg

SEQ ID NO: 329774 - DNA, 592 bp, Homo sapiens
  misc_feature: GZ8MTXP02HW4AS.13.85.H08.1.454.CMB.2.raw
  modified_base (237)..(237): a, c, t, g, unknown or other
  misc_feature (237)..(237): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcgagtgaagtctttccngcaagtcatcgtgggtacagcttcaccagccactacatgccacgtcgggtccacgacggccccctgggactaaggtccttggaggtggatggggaactaagccactcccaagtcggtagagtcgggacttggacccttacgccacgaagtaacgtttccgaaggggcagacgtcaacgatacgacgagggaccacgtaccacgaagaacgagactagtttggagttcgagcagcctgagatcgtcgacgacgacggtaccgtttatacgtgtcgcgtacgagtaacttaagtacgtaaccgtaaaccgtaacgttacgggaaacggtttcggttttagggggtacggtttacggg

SEQ ID NO: 329775 - DNA, 584 bp, Homo sapiens
  misc_feature: GZ8MTXP02HXHRA.13.85.H08.1.454.CMB.2.raw
  modified_base (236)..(236): a, c, t, g, unknown or other
  misc_feature (236)..(236): n is a, c, g, or t
  modified_base (471)..(471): a, c, t, g, unknown or other
  misc_feature (471)..(471): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctgggggcctcagtgaagctttccngcaagtcatcgtgggtacagtcttcaccagccactacatgcacgtcgggtccgacacggcccccgtgggaccaaggttctggacgtggagtaggggactaaatccacctcctaagtcggtagagtgggactgacctaacggctaacgagtagtttcgaagggcagacgtcaacatcgaacgagggaccacgtccgaacgacgaacagtactaagtttggagttgagcagctaganacgtcgacggtacgacgtacggtactttacttacgtggtacggaccgcgtaacgtataacgtactaacgactaaacgtcgggaacgtttcgggtttaggggtcggttaccggg

SEQ ID NO: 329776 - DNA, 599 bp, Homo sapiens
  misc_feature: GZ8MTXP02HFJYG.13.85.H08.1.454.CMB.2.raw
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagtctttccngcaagtcatcgtgggtacagtcttcacacgccactacatgccacgtcgggtacccgacgacggccccgtgggacacggttctggacggtggagtacgggactaacgtccacctccgtaagtcggtagagtcgggactcgacctacgcgactaaggtacgttcgaagggcagacgtccacacgtcgaccgaggaaccacgtaccgaacgaacgaacgagtacttagttaggtagttgagcgacgcagacgactcgtacgacgtacgtacgttacgtttacgtacgtgtacgcgacgtacgtaagtagtacgtaacaacgtacggttacggtaacgggtttcggtttgggttacggttccggg

SEQ ID NO: 329777 - DNA, 552 bp, Homo sapiens
  misc_feature: GZ8MTXP02HQWC5.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttcctgcaagtcatctgggtacagcttcacagccactacatgcacgtcggtcccgacgacggtcccccgtgggccaaggtctttggagtggatggggactaaatcacctccaatcggtgatggggactgacctacgcacgtaagtagtttcgagggcagacgtcaacatcgaaccagggacacgtaccaacgagaaccagactagtttaggagttagagcagcctgagatcgtgacgacgtacgtccgtttattactggtcgcggacagataagtacgtaacaacgacgtaggaacggttcggtttggggtcgtttccggg

SEQ ID NO: 329778 - DNA, 594 bp, Homo sapiens
  misc_feature: GZ8MTXP02IUGAN.13.85.H08.1.454.CMB.2.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtcctttccngacaagtcatcgtgggtacngcttcaccagccactacatcgcacgtgggtacccacgacggccccgtgggccaaggtctggagtggatgggactaatccactacccaagtggtagactgggactcgccgtaacgcaacagtacgttcgagggcagacgtacaccagtagaaccgagggaccacgtaccgaacgaacgaaacgagtacttaaagtttggaacgttggacgagacgtcctaggagtatcgtacgacgacgtacggtactttaacgtcgtggtcgcgacgtacgtaactagtacgtaacgtacgaaacggttcggtaacgggttcggttttagggggcgtttacccgggg

SEQ ID NO: 329779 - DNA, 536 bp, Homo sapiens
  misc_feature: GZ8MTXP02HUFE5.13.85.H08.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (428)..(428): a, c, t, g, unknown or other
  misc_feature (428)..(428): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctnagtgaagctttccngcaagtcatctgggtacagcttcaccagccactacatgcactgggtccgacacggcccccgtgggcaaggtcttgagtggatgggactaatcactcccaatggtgatgggactgcctacgcacagaagtttcgaagggcagacgtcacatgacagggacacgtccacgagaacagactagtttggagttgagnagcctgagatcgtgacgacgacggtacccgtttattacgttggtcgcggcgaagactaaatagtaacaacgaacgtacggaacggtcggtttttggggtggtttcggg

SEQ ID NO: 329780 - DNA, 633 bp, Homo sapiens
  misc_feature: GZ8MTXP02GNC1U.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctgaggtgacgaagccgtggggcctcagtgaagtctttcctgacaagtcatcgtgggtacagtcttacacccacgccaactacagtcgcctacgtgggtcccgacgaccggcccccgtgggacctaaggttcgttagaggtggaagtagggacctaaatcctacctacccaagtcggtagagtcgggacttcggcccttaagcaactaaggtaacgttcgagggcagacgtacacagtcgaaccggaggaccacgtccaagaacgaacacgacgttagttaggaggttagagacgacgtccgtaggacgaacttcgaacggaccgtaccgtacggttaccgtttatacgtggtcggacgacgtagtaaactaacgtacgtaaccgaactaacggtacggggtaacggttcgggtttagggggttcggtttcccgggg

SEQ ID NO: 329781 - DNA, 567 bp, Homo sapiens
  misc_feature: GZ8MTXP02H33AY.13.85.H08.1.454.CMB.2.raw
  modified_base (404)..(404): a, c, t, g, unknown or other
  misc_feature (404)..(404): n is a, c, g, or t
tcagtcacgtactacacgaccggtgctcgatttagtatcactcagtcgcgggagcatcatccaacaaccacatcccttctctacagaagcctctgagaggaaagttcttcaccatggactggacctggagggtcttctgctcgctggctgtagctccaggtgttcatacccaggtacaactggtgcaatctggggctgaggtgacgaagcctggggcctcagtgaagcttcctgcaagtcatctggtacagcttcaccagccactacatgcacgtggtccgacacggcccctgggcaaggtctgagtggatgggactatcactcccaatcggtgagtgggactgccctacgcacaagtagtttcaggggcagacgtcacagtcgacgaggaccacgtccacganaacgagacttagttggagtgtagcagccgtagagtatcgtagacgacgtacggtacccgttttagtaccgttggtcggacgtacgagtaaacgttaagtaacgtaacgaacgtaaacggtacgggtaaaccggtttcgggttttgggggtacgggtttccggg

SEQ ID NO: 329782 - DNA, 568 bp, Homo sapiens
  misc_feature: GZ8MTXP02F2TI5.13.85.H08.1.454.CMB.2.raw
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
  modified_base (520)..(520): a, c, t, g, unknown or other
  misc_feature (520)..(520): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttcctgcaagtcatcgtggtacagcttcaccagccactacatgcacgtcgggtccgacgacggccccgtgggacgaaggtcttaggaggtggagtgggactaaactccacctacccaagtggtagagtgggactgccgtacgcacagtaagtttcgaggcgagacgtcaccanacgacgacggacacgaccaacgagaacagacttagttggagttgagtnacgctagagatcgtagacgacgtcggtactttacttcgtaggtcgacgacgagtaacgtaatacgtnaacgtaacgtcgggtaaccggttgggtttcggggtacggtttaccggg

SEQ ID NO: 329783 - DNA, 627 bp, Homo sapiens
  misc_feature: GZ8MTXP02G0Y2M.13.85.H08.1.454.CMB.2.raw
  modified_base (392)..(392): a, c, t, g, unknown or other
  misc_feature (392)..(392): n is a, c, g, or t
  modified_base (492)..(492): a, c, t, g, unknown or other
  misc_feature (492)..(492): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgaagccgtggggcctcagtgaagctttcctgcaagtcatcgtgggtacagcttcaccagccactacatcgcacgtgggtcccgacgacggcccccgtggggaccaagggttccttggacggtgggagtggggaacttaatccacctaccccgaagtccgggtagagtcggggactcgaccgtacncgacagtaacgttcgagggtcagacgtcaccagtcgaccgaggacaccgtaccgaacgagaacagacttaagttggagttcggaagcgacgtcctagganagtcgtagacccgaacgtacgggtaccgtttagttacgtcggtcgtaccggacggtacggtaactaaggttacgtaactacgaaaacgttcggggtaaacggttcggggttttagggggtacgggtttcccgggg

SEQ ID NO: 329784 - DNA, 542 bp, Homo sapiens
  misc_feature: GZ8MTXP02GJQR6.13.85.H08.1.454.CMB.2.raw
  modified_base (396)..(396): a, c, t, g, unknown or other
  misc_feature (396)..(396): n is a, c, g, or t
  modified_base (467)..(467): a, c, t, g, unknown or other
  misc_feature (467)..(467): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctgagtgaagtctttcctgcaagtcatcgtgggtacagcttcaccagccactacatgcacgtcggccgacacggccccgtgggacaaggtctggagtggagtggaactactcactaccatggagagtggactgacctacgcaacgtagtaagttcgagggacagacgtacactanacgacgaggcacgcagagacagactagtgagtgagcagtcagacgatcgtacgacgacgtacgtcgtttanacgtgtcgacgtacgaagtaatacgtagaacaacgtaacggtacggaacggttcggtttggggacggtttaccgg

SEQ ID NO: 329785 - DNA, 723 bp, Homo sapiens
  misc_feature: GZ8MTXP02JPI5Z.13.85.H08.1.454.CMB.2.raw
  modified_base (239)..(239): a, c, t, g, unknown or other
  misc_feature (239)..(239): n is a, c, g, or t
  modified_base (268)..(268): a, c, t, g, unknown or other
  misc_feature (268)..(268): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaaggcctggggcctgagtgaagtctttccngacaagtcatcgtgggtacagtctcgacngaccactacatcgcacgtcgggtacccgaacgaccggccccgttggggacgtaacgggttcttaggaggtagggagtcggggtaacttaaacgtcctacccgtacccgtaaagttcgggtacgagtcggggtacctcggtaccctacggaccaacgtaaggttaaacgtttccggaaggggtacagggacgtacaaccgtacgtacggaacccgacggggtacctaccggaccgaaacgaacgaacgacgtaacgttagtttaggggagttacggacgactacggaccgtaggacgttaactcgtacggaaaccgtaccgtacccggggttaccttttaacgtacgttagggtcggtacggtacgtaaagtaacgttaaagtaccgtaacgtaaaccggtaaacgttacgggggtaaacggtttcggggtttacgggggtaggtttcccccgggg

SEQ ID NO: 329786 - DNA, 581 bp, Homo sapiens
  misc_feature: GZ8MTXP02HIQ27.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgaagccgtggggcctcagtgaagtctttcctgcaagtcatctgggtacagctcaccagccactacatgcacgtcggtccgacgacggccccgtgggacaaggtcttggagtggagtacgggactaacgtcacctccgaagtcggtgagtgggactgcctacgcacaagtagttcgagggtcagagacaccagtcgacgaggacacgcaacgagaacagactagttggagttagagacgagcgtagagatcgtacggaccgacgtacggtaccgtttaacgttaccgtggtcggaccgacgaacgtattaacgtaacgtcgtaacgtaacgtacgggtaacggttcgggtttacgggggttcggtttacccgggg

SEQ ID NO: 329787 - DNA, 677 bp, Homo sapiens
  misc_feature: GZ8MTXP02HF9UQ.13.85.H08.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgagccgtggggcctnagtgaagtctttcngcaagtcatcgtgggtacagtcttacaccacgccaactacatcgaccacgtcgggtaccacgaccggcccgtgggacgaaggtctggaggtggagtggactagtcactcctagtcggagagtgggactcgaccacgcaacgtagtaacggttcgagggacgacgacgtaccacgtacgtacgaccggacggaaccgaccgtaccgaacggtaacgaaaccgagtaaccgtttaggtttagggtaaacgttggaaacgtccgacgggtacccgttaaggacgtacgttacggttacggaaacggtaccgtaaccggggttaccttttaactacggcggttaccggaggaccgtaagtaacgttaacgtaacgtaacgtaaacgtacggttacggggtaaccgggtttcggggttttacgggggtcgggtttaccccggggg

SEQ ID NO: 329788 - DNA, 736 bp, Homo sapiens
  misc_feature: GZ8MTXP02H0QHU.13.85.H08.1.454.CMB.2.raw
  modified_base (235)..(235): a, c, t, g, unknown or other
  misc_feature (235)..(235): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgagcctggggctcgagtgaagtcttccngacagtcagtctgggtacagcttcgaccagccactacatgcacgtcggtccgacgacggccccggtggaccgtaaggtcgttggaggtgggagtaggggtactaatcctaacctacccgtaagtcgggtagacggtggggacctcggaccgttacgccgtaacgaaggtaacggtttacgaagggtcgaaggtacgtaccgtaaccaaggtccgaaccggacggaacccgtaccggtaccgaacggaacgaaaccaggtaaccgttaaggttgggtagtttacggagtaccgacgtacccgtgaacgtacggttaccgaggtaaacccggtaccgaaccgggtttaccgttttaacgttaacggttcgggttacgacccggggtaaacggtaacttaaagtaaaccgttaacggttaacccgaaacgtaaacgggttaccgggggttaaaggggttacgggggttttttaccggggggttcgggttttaacccccgggggg

SEQ ID NO: 329789 - DNA, 610 bp, Homo sapiens
  misc_feature: GZ8MTXP02HNYOY.13.85.H08.1.454.CMB.2.raw
  modified_base (237)..(237): a, c, t, g, unknown or other
  misc_feature (237)..(237): n is a, c, g, or t
  modified_base (361)..(361): a, c, t, g, unknown or other
  misc_feature (361)..(361): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcagtgaagtctttccngcaagtcatctgggtacagcttcaccagccactacatgcacgtggtcccgacgacggccccgtgggcaaggtcttgaggtggagtggactaatcacctccagtggtagagtggactgcctacgnacgagtaagttcgaggggcagacgtcacagtacgacgaggacctacgtacccgaacgaacgaacagtacttagtttcgggaagttggagaccgaaggtccctagggaactaactgtacggaaccggtaaccgtaccggggtacctttttaagttaccgttaggtcgtacggacgagtaaacttaagtacgtaacgtaaacgtaacgtacgggaacgggtttccggtttagggggttaggtttcccgggg

SEQ ID NO: 329790 - DNA, 651 bp, Homo sapiens
  misc_feature: GZ8MTXP02H68FZ.13.85.H08.1.454.CMB.2.raw
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctggaggtgacgaagccgtggggcctcagtgaagtctttccngcaagtcatcgtgggtacagcttcaccacgccactacatcgcacgtcgggtcccgacgacggtccccgtgggcaaggtctgagtggagtgggactaactcacctaccgtaagtcggtagagtacgggacgttcgaccgttacgcgaacgtaagttaacgtttcgagggtcgagtacgtaccaacagtcgaaccgaggacctaccgtccgaacgagaaactagtacttaggtttggtaagttggacgtacgagtacccgtaggaagacttacgaggaaccgtacgtaccgggtttacccgtttagttacgttacggtcgaccggaacggtacgtaaacttaagtacgtaacgtaccgtaaaacggttcggggtaaacggtttcggggtttacgggggttacgggtttcccgggg

SEQ ID NO: 329791 - DNA, 668 bp, Homo sapiens
  misc_feature: GZ8MTXP02I86V2.13.85.H08.1.454.CMB.2.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
tcagtcacgtactacacgaccggtgctcgatttagtatcactcagtcggcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggggctggaggtgacgaagcctgggggcctgagtgaagtctttctgcaagtccatctggggacngtctcacacnccacangcgcacgtcggtaccgacgccggcccggcggcgtacggtacgtaggtaggtggtaggtacggtacgtaactacctaccgtaccgtacgtacggtaggtacggtacggtacgtcgtaccgtacgcgaacgtacgttaacggtacgacgggacgacgacgtaccgacgacgacggacggacggaccgaccgaccgaacgaacgaacgtacgtaacgttaggtaggtaggtagacgacgacgtacgtagacgtacgtacgtacggacggtaccggtaccgttacgtttacgttacgtaggtacggacggtacgtaacgtacgtaacgtaacgtaacgtaacggtaacggtacggggttacggggtttacggggtttcggggtttacgggttccggg

SEQ ID NO: 329792 - DNA, 702 bp, Homo sapiens
  misc_feature: GZ8MTXP02FMBON.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagccgtggggcctcgagtgaagcgtttcctgcaagtcatcgtgggtacagcttcaccagcccactacatgcacgtgggtaccgacgacggccccgtgggacaaggtcctttggaggtggatcggggaacttaaagtccaaccttccccaaagttccggtgaagtcggggacttggacccttaacgccaacgaaggtaaagtttccgaggggacaggacggtccaccgtagtcgaaccgaggggaaccaccgtacccgaaggaacgaaacgaacggtaaccttaaggtttacgggaagtttggaacggttacgaaacgggtcccttaggaacgtacgtcgtaggaaccgaaccgtacggttaccccgttttaagttaaccgttcggttacgaccggacgaacggttaaataacgttaacggaacctaaacggaaccggttaacgggggtaaacggggtttacgggtttttacggggggtcggttttacccggggg

SEQ ID NO: 329793 - DNA, 656 bp, Homo sapiens
  misc_feature: GZ8MTXP02HMBGD.13.85.H08.1.454.CMB.2.raw
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgagccgtgggcctcagtgaagtcttccngcaagtcatcgtggtacngtctcaccncgccactacatgcacgtcggcccgacgaccggccccgtggaccgtaaggtcgttaggaggtggagtcgggacttaatcctacctacccgagtcggagtagtcggggactcgcctacgctaacgtaggtaacgttcgaggggtcaaggtactaccacgtaacgtcgaaaccgacgggaccaaccgtccaaacggaacgaaacgtacgtacgttaaggttgggtaagttcggtaacgctacggacttaggacgtcgtacgtacggtaccggacgtaccggttaccgtttaagttaccgtggtccggacgtacgacgtaattaaacgtcgtaaccgtaacgtacgggttaacgggttaccggtttagggggtttcgggggtttacgggttcccgggg

SEQ ID NO: 329794 - DNA, 705 bp, Homo sapiens
  misc_feature: GZ8MTXP02HRZ48.13.85.H08.1.454.CMB.2.raw
  modified_base (238)..(238): a, c, t, g, unknown or other
  misc_feature (238)..(238): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctgaggtgacgaagccgtggggcctcagtgaagtctttccngacaagtcatcgtgggtacagcttcacacgaccactacatgcacgtgggtcccgacgaccggcccccgtgggaccgtaaggttcgttaggacggtggagtcgggtaactaacgtccacctccgaagtggtagtacgtgggtacttggacccgtagcctaacgtaaggtacgtttcggacgggcgaaggtacgacaacccgtaagacgaaccgacggacccgttacgaccccgaagaaccgaaacgtacgtacgttagtttgggagttacggagaccgttaggccgttaaggacgtacgttacccgtagaacggtacccgaacggggtttcttttaaaccgtaggtttcgtaccggtccggaacggtacgtaaagttaactaacggttaaccccgaaaggttaaacccggttaggggtaaaaccgggtttcggggttttaacgggggtttcggggtttaacccggggg

SEQ ID NO: 329795 - DNA, 606 bp, Homo sapiens
  misc_feature: GZ8MTXP02I79OD.13.85.H08.1.454.CMB.2.raw
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagtctttcctgcaagtcatctgggtacagcttcgaccagccactacatgcacgtgggtccgacacggccccgtgggcaaggtcttgagtggagtggactatcactccaagtggtgagtgggactgccctgcacagagttccgaggcagagtcacatcgaccgaggacacgtaccgacgagaacagacttacgttggaacgtttggaacgtcaacgtcccgtagaggtactcgtacgaccggtaccgtacgggtaaccgtttacgttacgttgtcggtacgtacggacgtaaagttaacgttaacggtaacctaaacgtaaccggttacggggtaaaccggggtttaccggggttttgggggttacgggttttcccggggg

SEQ ID NO: 329796 - DNA, 636 bp, Homo sapiens
  misc_feature: GZ8MTXP02F2MAE.13.85.H08.1.454.CMB.2.raw
  modified_base (239)..(239): a, c, t, g, unknown or other
  misc_feature (239)..(239): n is a, c, g, or t
  modified_base (481)..(481): a, c, t, g, unknown or other
  misc_feature (481)..(481): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtgggcctcagtgaagtcctttccngcaagtcatcgtgggtacagccttcaccagaccaactacatcgacacgtcgggtacccgacgacggcccccgtgggaccgtaaggtcgttggaggtggagtagggacttaatccacctacccgtagtcggtagtagtggactcgacccgtacgcgaacgagtaagtttacgagggacagactacacagtacgacgaggactacgaccgagaacgaagagaacttagtttaggagttaggacncgacgcgtagagtacgtcgtacgaccgacgtaccggttacgtttaacgttacgtggttcgacggacgaacgttaagttaacgtacgtaacccgtaaacgtaacccggtaggggttaacggtttcggggttttacggggtacggtttacccggggg

SEQ ID NO: 329797 - DNA, 740 bp, Homo sapiens
  misc_feature: GZ8MTXP02GE1RZ.13.85.H08.1.454.CMB.2.raw
  modified_base (237)..(237): a, c, t, g, unknown or other
  misc_feature (237)..(237): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctgaggtgacgaagccgtggggcctcagtgaagtctttccngcaagtcatcgtggtacagtcttcaccagcccactacatcgacctacgtcggggtacccacgaccggcccccgtagggaccgtaaggttcttaggaggtacggagttacggggaaccttaaacttccgaacctaccccgtaagtccggtagtagtcgggactcgacccgtacgccaacgtaggttaacggtttcgaacgggacgaaggtaccgtaccaacccgtaagtaccggaacccggacgggtaacccgtaccggaccccgaaacggaaacgaaaccgtaacggttaacttaacgggttttaggtaaggtttacggaacgacctaccgggtaccgtaggacgtacgttacgttaacggaacccgtaaccgggtaccgtttaccgttttaacgttaccgttggtacgtacggaacgtaagtaaacttaagtacgaaccgtaacgtaacggtaccggggttacggtttacggggttttacgggggtacggtttaccccgggg

SEQ ID NO: 329798 - DNA, 736 bp, Homo sapiens
  misc_feature: GZ8MTXP02JVRSS.13.85.H08.1.454.CMB.2.raw
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaacgtggtgcaatcgnggggctggaggtgacgaagccgtggggcctcgagtgaagtctttccngcaagtcatcgtgggtacagcttacaccacgcccactacatcgcctacgtcggtaccgacgaccggccccgtagggaccgaaggttcgttaggagggtcggtaaggtcgggtaactaaacgtacctacccgtaccccgtaagtcgggtagtaggtcggggtaaccttcggacccgttacgccgtaaccgaaggttaaacggtttaccgaggggtacaacgtacgtaccgaacctagtacggaacccgaacggggacccaaaccggtacccgaaacggaacgaaacctaggtaaccgtttaaaggttacgggaggtttacggacgtacggacggtaccgtaggaaagtcggttacgaacggaaccgtaccgggtaccggtttaccgtttttaaagttccgtagggtaccgaccgggagtaacgtaataacggtacgtaaccgtacgtaacgtacggggtacggtttcggggtttacgggggtgtttaccccggggg

SEQ ID NO: 329799 - DNA, 788 bp, Homo sapiens
  misc_feature: GZ8MTXP02GIY60.13.85.H08.1.454.CMB.2.raw
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtgggctgaggtgacgaagcctgggcctcagtagaagtcttcctgcaagtcatcgtgggtacngtctcaccacgctactacatgacacgtcggaccgacgacggccccgtaggacgaacgtcgtagtagnggtacgtgggactaatcacctacccgtaagtcggtagtacgtagggtaccgtacgtaccccgttaacgccctaaagtaaacgggtaaacgttttacgggaacgggggacgtaaacggtaacgggttaccaaacccgtaaacggtacccgaaaccggggtaacccgggggaacctaaaccccggacccggaaaccggaaaccgtaaaccgtaaacgtaaaccgttaggttttaaaggggtacggtttaacggaggtaccgtaaccgggacccggtttaaggaacggttaccgtttacctaccggtaaaccggaacccggtaaacccgggttttaccggtttttaaaacttcccggtttaaggttcggaccggttacggaagtaaaacctaggttaacttaaccgaaacgtaaacgggttacggaaccggggttttgggttttaacgggggtcggttttaacccggggg

SEQ ID NO: 329800 - DNA, 641 bp, Homo sapiens
  misc_feature: GZ8MTXP02HD7AI.13.85.H08.1.454.CMB.2.raw
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (479)..(479): a, c, t, g, unknown or other
  misc_feature (479)..(479): n is a, c, g, or t
  modified_base (519)..(519): a, c, t, g, unknown or other
  misc_feature (519)..(519): n is a, c, g, or t
tcagtcacgtactacacgaccggtgctcgatttagtatcactcagtcgcggggagcatcatccaacaaccacatcccttctctacagaagcctctgagaggaagttcttcaccatggactggacctgggagggtcttctgcttgctggctgtagctccaggtgttcatacccaggtacaactggtgcaatcgtggggctggaggtgacgaagccgtggggcctcgagtgaagtcttttcgngacaagtcatcgtgggtacagcttcacacgaccactacagtcncacgtcgggtaccacgcggccccgtaggganaacggttctagggacgtggagttagggtaactaacgtcacctaccgaagtgggttacgacgtcggggtactacgcccgttaaggcctaagaaaggttacgtcggagggtacagacgtacacccaagtacgaacggacggtaccgtacgaaccgacgaacgaacngtaaattacgttaggagtagacgtacacgctgaacgttcnctacggaccgaagtacggttacccgtttataccgtgtcgaccggtacgtaagtaactaagttacggaactaacgtaaaccgtggggaaccggtttcgggtttaggggtcggtttacccgggg

SEQ ID NO: 329801 - DNA, 534 bp, Homo sapiens
  misc_feature: GZ8MTXP02G4QBI.13.85.H08.1.454.CMB.2.raw
  modified_base (248)..(248): a, c, t, g, unknown or other
  misc_feature (248)..(248): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (509)..(509): a, c, t, g, unknown or other
  misc_feature (509)..(509): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcgagtgaagctttcctgcaagtcatcgnggtacagcttacaccagccactacaatcgacacgtcggtcccgacacggtccccgtgggcaaaggtctagagtggatggataancactaccaatgacagngtacncgtacacgcacacgtaaagttcgaggcagtacgacacancgaacgagggactacgaccacgaagaacganactagttggaaagtgagacagtccagagatcgtagagacgtacgacgttataccgtgcgtacggatacgataacataacagtacgngaacgtcggtttggggtacgtcggg

SEQ ID NO: 329802 - DNA, 589 bp, Homo sapiens
  misc_feature: GZ8MTXP02I4TFB.13.85.H08.1.454.CMB.2.raw
  modified_base (238)..(238): a, c, t, g, unknown or other
  misc_feature (238)..(238): n is a, c, g, or t
  modified_base (378)..(378): a, c, t, g, unknown or other
  misc_feature (378)..(378): n is a, c, g, or t
tcagtcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatcgtggggctggaggtgacgaagccgtggggcctcagtgaagctttccngcaagtcatcgtggtacagcttcaccagccactacatgcacgtagggtccgacgacggccccctggggccaaagggtccttggaggttcggatggggactaaagtccactcccaatggcgagttgggactgaccttacgnaaccaggaaactttcgaggggctagagtcacatgacagggacacgtacacgagaacagactaagttggaaagttgagacgcggaacctggaatcgtacgtagaccgacgaacggtcccgtttataaccgttgtcgaccgacgaggaacttaagttacgtaaccaaacacgtacggtaaacgggtccgtttacgggggtaggtttcccgggg

SEQ ID NO: 329803 - DNA, 508 bp, Homo sapiens
  misc_feature: GZ8MTXP01BX1E5.44.59.F04.1.454.CMB.2.raw
  modified_base (373)..(373): a, c, t, g, unknown or other
  misc_feature (373)..(373): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
  modified_base (500)..(508): a, c, t, g, unknown or other
  misc_feature (500)..(508): n is a, c, g, or t
tcagacagtatatacacgaccggtgctcgatttagtacacacacttagggattggggggtgtggtggtctccactcccgcccagtctgtgctgactcagccatcctcagcgtctgggacccccgggcagacggtcacgatcttttgttctggaagtaggtccaacatcggaagtaattacgtatactggtatcggcaattcacaggagcggtccccagacccctcatctatagggagaatcagcggccctcaggggtccctgaccgattctctgcctcaagtctggcactcagcctccctggccatcagtgggctccggtccgaggatggaggctgatttatttctgtgcggtccttggggatgacatcctgngtggactgctattcgggcggagggaccaagctgaccgtctaagtcagccaaggcncgcccctcgtcactctggttcccccnccctcctctatactactgtctgcggcggcgtggcacggcgcattgnnnnnnnnn

SEQ ID NO: 329804 - DNA, 513 bp, Homo sapiens
  misc_feature: GZ8MTXP01DTXG5.44.59.F04.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (508)..(508): a, c, t, g, unknown or other
  misc_feature (508)..(508): n is a, c, g, or t
  modified_base (510)..(513): a, c, t, g, unknown or other
  misc_feature (510)..(513): n is a, c, g, or t
tcagacagtatatacacgaccggtgctcgatttagtacacacacttagggattgggggggggtgtggtggtctccactcccgcccagtctgtgctgactcagccatcctcagcgtctgggacccccgggcagacggtcacgatcttttgtctggaagtaggtccaacatcggaagtaattacgtatactggtatcggcaattcacaggagcggtccccagacccctcatctataggganaatcagcggccctnaggggtccctgaccgattctctgcctcaagtctggcacctcagcctccctggccatcagtggctccggtccgaggatgaggctgattatttctgtgcggcttgggatgacatcctgngtggactgctattcgggnggagggacaagctgaccgtcctaagtcagcccaaggctcgcccctcggtccacgtcttcgttccccgccctccctctacttactaacgtcgtcctggagcgggccgtgcgaaggcgcaangnnnn

SEQ ID NO: 329805 - DNA, 510 bp, Homo sapiens
  misc_feature: GZ8MTXP01BLTMJ.44.59.F04.1.454.CMB.2.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (500)..(510): a, c, t, g, unknown or other
  misc_feature (500)..(510): n is a, c, g, or t
tcagacagtatatacacgaccggtgctcgatttagtacacacacttagggattgggggggtgtggtggtctccactcccgcccagtctgtgctgactcagccatcctcagcgtctgggacccccgggcagacggtcacgatcttttgttctggaagtaggtccaacatcggaagtaattacgtatactggtatcggcaattcacaggagcggtccccagacccctcatctatagggagaatcagcggccctcagggggtccctgaccgattctctgcctcaagtctggcacctcagcctccctggccatcagtgggctccggtccgaggatgaggctgattatttcngtgcggtccttggggatggacatccctgngtgggactggctagttcggcggaggacaagctgaccgtcagtcagcccaaggctcgcccctcgtcactctcgtccccacctcctctatatactgtcctgacgcggctggccaaggcgcattagnnnnnnnnnnn

SEQ ID NO: 329806 - DNA, 497 bp, Homo sapiens
  misc_feature: GZ8MTXP01ALXIG.44.59.F04.1.454.CMB.2.raw
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
  modified_base (480)..(497): a, c, t, g, unknown or other
  misc_feature (480)..(497): n is a, c, g, or t
tcagacagtatatacacgaccggtgctcgatttagtacacacacttaggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagacggccctggtaccagcgagtggtacctntactactactctctggacgtcgtgggggcccaggggaccgcggtccaccgtctccncacgcctccaccgacgggcccagtcgtccttccccctggcctaacccgtcctccaacgacgccaccgtcgtcgggggcacgacgccggcccgtcggggcctcgtccgtgggtacgaaaacggtaccttaaccttcctaattaacttacgttcgtcgtcggtacgggcgggtacgtcggacgaacgggcgacagtagnnnnnnnnnnnnnnnnnn

SEQ ID NO: 329807 - DNA, 561 bp, Homo sapiens
  misc_feature: GZ8MTXP01C224O.44.59.F04.1.454.CMB.2.raw
  modified_base (133)..(133): a, c, t, g, unknown or other
  misc_feature (133)..(133): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (518)..(518): a, c, t, g, unknown or other
  misc_feature (518)..(518): n is a, c, g, or t
  modified_base (548)..(548): a, c, t, g, unknown or other
  misc_feature (548)..(548): n is a, c, g, or t
  modified_base (551)..(561): a, c, t, g, unknown or other
  misc_feature (551)..(561): n is a, c, g, or t
tcagacagtatatacacgaccggtgctcgatttagtacacacacttagggattggggggggggtgtggtggtctccactcccgcccagtctgtgctgactcagccatccctcagcgtctgggaccccccgggnagacggtcacgatcttttgttctggaagtaggtccaacatcggaagtaattacgtatactggtatcggcaattcacaggagcggtccccagaccccctnatctataggganaatcagcggccctcgagggggtccctgaccgattcnctgcctccaagtctggcacctcacgccctccctggccatcagtgggctccggtcgagntgaggctgattattcngtgcggtccttgggatganactctgngtgactgctgttcgggnggacgggaccagctacgacccgtcctaagtccgaacgccccaaagggcctccgccccccgtcgggtacccaccgttccgttccgtcccccgtcccctccctactagttactactcgttcgnggacggcgggctcgggctaaggccgactanggnnnnnnnnnnn

SEQ ID NO: 329808 - DNA, 517 bp, Homo sapiens
  misc_feature: GZ8MTXP02FXJZE.44.59.F04.1.454.CMB.2.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (503)..(503): a, c, t, g, unknown or other
  misc_feature (503)..(503): n is a, c, g, or t
  modified_base (507)..(517): a, c, t, g, unknown or other
  misc_feature (507)..(517): n is a, c, g, or t
tcagacagtatatacacgaccggtgctcgatttagtacacacacttagggattgggggggtgtggtggtctccactcccgcccagtctgtgctgactcagccatcctcagcgtctgggacccccgggcagacggtcacgatcttttgttctggaagtaggtccaacatcggaagtaattacgtatactggtatcggcaattcacaggagcggtccccagacccctcatctataggganaatcagcggccctnaggggtccctgaccgattctctgcctcaagtctggcacctcagcctccctggccatcagtgggctccggtccgaggatggaggctgatttatttcngtgcggccttgggatgacatcctgngtggactgctattcggngggagggacagctgaccgtctaagtcacgcccaaggctcgccccctggtccactcctcgttccccgccctcctctactactactgtctgacgcggtctggcaacggcgactanacgnnnnnnnnnnn

SEQ ID NO: 329809 - DNA, 512 bp, Homo sapiens
  misc_feature: GZ8MTXP02HN7D5.44.59.F04.1.454.CMB.2.raw
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (503)..(512): a, c, t, g, unknown or other
  misc_feature (503)..(512): n is a, c, g, or t
tcagacagtatatacacgaccggtgctcgatttagtacacacacttagggattggggggtgtggtggtctccactcccgcccagtctgtgctgactcagccatcctcagcgtctgggacccccgggcagacggtcacgatcttttgttctggaagtaggtccaacatcggaagtaattacgtatactggtatcggcaattcacaggagcggtccccagacccctcatctatagggagaatcagcggccctcaggggtccctgaccgattctctgcctccaagtctggcacctcagcctccctggccatcagtgggctccggtccgaggatgaggctgattatttctgtgcggccttggggatgacatccngngtggactgctattcgggcggagggaccaagctgaccgtctaagtcagcccaaggctcgccccctggtcactctcgttccccgccctctctatactactgtctgagcgggtctgggcaacggcgcagtacgnnnnnnnnnn

SEQ ID NO: 329810 - DNA, 599 bp, Homo sapiens
  misc_feature: GZ8MTXP02F0CZQ.44.59.F04.1.454.CMB.2.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (588)..(599): a, c, t, g, unknown or other
  misc_feature (588)..(599): n is a, c, g, or t
tcagacagtatatacacgaccggtgctcgatttagtacacacacttagggattgggggggggtgtggtggtctccactcccgcccagtctgtgctgactcagccatcctcagcgtctgggaccccccgggcagacggtcacgatcttttgttctggaagtaggtccaacatcggaagtaattacgtatactggtatcggcaattcacaggagccggtccccagacccctnatctatagggagaatcagccggccctcgacggggtccctgaccgtattctctcgccctccaagtctggcacctcacgccctcccnggccatcaggtgggcctccggtccgaggatgaggtctgatttattcgngtggcggtctttgggatgactntccgtgngtggactagtacgttcgggacggtacggacgaagccgtacggacccgttacgtaacgtccgaacgaccccgaaacggcccgtccggacccccctcggggtaccctacccgttccgttcccggttacccccgccccttacccgtacttactactacttcgtcgcggagccgggctcggcgaacgtcgacaacgtcgnnnnnnnnnnnn

SEQ ID NO: 329811 - DNA, 563 bp, Homo sapiens
  misc_feature: GZ8MTXP01EHVXE.45.86.H09.1.454.CMB.2.raw
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggatggtatctgcagaagccagggcagtctcctnagctctgatcttatttgggtctgatcgggcctcccggggcctgacagttcaagtgcagtggatcaggcanagtatttacactgagaatcgagcgaaaggnggagagtggagtagttggggttacggttacgttttaatacgtgtcgtagtagtacgtaagttagttactacttacctttaactttacgtttacggtaccggttacgggtacggtacggttacgttggttagtaagtaacgtaaacgtaacgtaggttacggtcgttcgtcg

SEQ ID NO: 329812 - DNA, 611 bp, Homo sapiens
  misc_feature: GZ8MTXP01CZW6P.45.86.H09.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatgatacaactattgatggtatctgcagaagccaggcagtctctnagctctgatcttagttgggttctgacgtccgggcctccccggggtcctgactggttcaagtgctagtgatcgaggcactagtatttacactgagaatcgagacgaagtggaagtacgtaggaggtaagtttggggtttagggttacgttttaagttaaccgttggtaccttaagttggtaacgttaaagggttttacgtaccttaccgtttaccttttaacgtttaaccggttttcgggaccgggttaaacggggacccgtaagggttcgttagggagtaacgttaaccgaaaacgtaacgtggttacggtcgttcgtaacccg

SEQ ID NO: 329813 - DNA, 601 bp, Homo sapiens
  misc_feature: GZ8MTXP01A06T7.45.86.H09.1.454.CMB.2.raw
  modified_base (352)..(352): a, c, t, g, unknown or other
  misc_feature (352)..(352): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctcccctgcccgtcacccctggagagccggcctccatctcctgcaggtctagtcagagcctcctgaatactaaatggatacaactatttggattggtatctgcagaagccaggcagtctcctcagctcctgattcttagtttgggttctgacgtcgggcccctccggggtcctggacnggttcagtggcaggtgatcgaggcacgagtatttacactgagatcgagacgaagtggagacgtaggaggtagttggttaggttacgtttagttacgtggctagtggtacgtaaagggttttactccgtaccgttcctttaacgtttacggttttacggggacccggtaacgggggtaacccgttaggggttccgttaggggaacgtacgttaaccgaaaaccggtacgttagggtcgggttaacgtccg

SEQ ID NO: 329814 - DNA, 566 bp, Homo sapiens
  misc_feature: GZ8MTXP01AIB0M.45.86.H09.1.454.CMB.2.raw
  modified_base (293)..(293): a, c, t, g, unknown or other
  misc_feature (293)..(293): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgccccgtcacccctggagagccggcctccatctcctgcaggtctagtcagagcctcctgaatactaatgatacaactattggatggtatctgcagaagccgagggcagtctcctnagctcctgtatcttagttttgggtctgacgtccggggcccttccccgggggtaccctggactaggttcaaggtggcaggtcggatcgagggcacagtattttacactgaagaatcgagacgtaaggtggagatggagtagtggggtttggtcgtttatacgttgctgtagtacgtaaggtttatctaaccttctttaattacgttttggaccgacgggggtaccaggcgttgggagtaacgtacaaacggtaactggttcgtcgttcgaaccg

SEQ ID NO: 329815 - DNA, 583 bp, Homo sapiens
  misc_feature: GZ8MTXP01C6USI.45.86.H09.1.454.CMB.2.raw
  modified_base (320)..(320): a, c, t, g, unknown or other
  misc_feature (320)..(320): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagcccggcctccatctcctgcaggtctagtcagacgcctctgaatactaatggatacaactattggattggtatctgcagaagccagggcagtctcctcagctcctgattctagttttgggtntgtagtccgggtccccgtccggggtcctgacgtaggttcaggtggactaggtggactcgagggcacgtagttatttacacgtagaagaatacgagagaaggtggagtagtagtaggtaggtggtttggtagtttatagtgctagtacgtacgttaaggttactacctacttctttaacgttcgtttacggcgtaacgggtacccgaggttccgttaggtaagtaacgtaacgtaaaacgtacgttggtaacggttcgtaaccg

SEQ ID NO: 329816 - DNA, 558 bp, Homo sapiens
  misc_feature: GZ8MTXP01EOHTN.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctctgaatactaaatggatacaactattggattggtatctgcagaagccagggcagtctcctcagctcctgacttcttagtttgggttctggacgtccggggcccccttccgggggtcctggaccagggttcagtggcaggtggatcgagggcaacagtatttacactagaataatacgagacgaagtaggagacgtagaggtagtggtttggtccgtttaatacgtgactagtgactaaggtttacactacttccttattacgtttcggaccgaggggtaccaggttcttagggaacataaccgaaagtacgttgtcggaactg

SEQ ID NO: 329817 - DNA, 573 bp, Homo sapiens
  misc_feature: GZ8MTXP01DTEPF.45.86.H09.1.454.CMB.2.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (393)..(393): a, c, t, g, unknown or other
  misc_feature (393)..(393): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagacgcctctgaatactaatggatacaactattggattggatctgcagaagccaggcagtcnctnagctctgatcttagtttgggtctgagtccgggccccgttccgggggtcctggacctaggttcaggtgcaggtggatcgaggcacagtatttacactgaanatacgagtacgaagtggagagtagaggagtgttcggtagtttatacgtgctagtacgtagtaagggtttagtcctaacttccctttaagttaccgttttacgggcccgtaaagggggacccgttagggcgttaggggaatacgttaaccgaaaaccggtacgttggtaacggcgtaaccg

SEQ ID NO: 329818 - DNA, 620 bp, Homo sapiens
  misc_feature: GZ8MTXP01BJJNC.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgattcttagtttgggtctgagtcgggcccctccggggtcctgacaggttcagtggcaggtggatcgaggcacagtatttacactgagatcagacgaagtggagacgtagaggtaggttggtttggtacgtttaattacgtgtcgtagttaggtacgttaaaggggtttacgtaccgttaaccttaaccgttttaacgttaccggtttttcggggaccccggtaaacggggggttaacccgaacggggttccgttacgggggaaaggtacttaaaccggaaaacggtaaccggttgggttaacggggttccctaacggg

SEQ ID NO: 329819 - DNA, 667 bp, Homo sapiens
  misc_feature: GZ8MTXP01EK914.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctcctagaatactaagtggaatactaacttatttggattggtatctgacagaacgccgaggcagtcctccgtcagtcctctagtactttcgttagtttggttctggtacgtccgggtcccccgtccgggggtcctaggtaccgtaggttacaggtcgggactagggtcggactacggaacgggctaaacgtagttaacttttaacgacgtaggaagtaatacgaaggacggtaaggtaggaagtagtagggtaaggttaagggtttgggtttacgggtttacgttttaacgttacgtcgtacgtagttagtaacgttaagggtttactacctactttaacgtttacgtttacggtttacgggaccggtacgggtaccgttaaggttcgttaggaacgtacgtaacgaaacggtacgttggtcgttcgtaacg

SEQ ID NO: 329820 - DNA, 603 bp, Homo sapiens
  misc_feature: GZ8MTXP01BRUG6.45.86.H09.1.454.CMB.2.raw
  modified_base (586)..(586): a, c, t, g, unknown or other
  misc_feature (586)..(586): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcaccctggagacgccgcctccatctcctgcaggtctagtcagacgcctctagaatactaaatggaataacctaattagttggattggtatctgacaagaacgccgaagggcctacgtcctcctcagtcctcctagtactttcgtttagtttcgggttctgcgtccggggtccccgttcccggggtcctgaccgtaggttcaggtggctaggtgatcgaggactatagtatttacacgtagaagaatacgagagaaggtagagagtagaggtagttcgttaggtagtttagtactgatagtcgtacgttaagggtttactactaactttaactttaaagttcggtttacggaccggtaaggggtaccagggaccgttaggaagtaactaacgtaaaacgngttaggtcgttcgtaag

SEQ ID NO: 329821 - DNA, 540 bp, Homo sapiens
  misc_feature: GZ8MTXP01DR6T7.45.86.H09.1.454.CMB.2.raw
  modified_base (403)..(403): a, c, t, g, unknown or other
  misc_feature (403)..(403): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaaatggatacaactattggattggtatctgcagaagccagggcagtctcctcagctcctgattcttatttgggttctgatccgggcccctccggggtcctgacaggttcagtggcagtggatcaggcacagtatttacactgagaatcagcgaagtgganatagaggagtggttggtcgtttatactgcatgactaagggtttatctacttccttattacgttttgggccgtaagggggtaccaagggcttaggggaatacgttaacgaaaaccgtaacgttaggtcgggccttcgg

SEQ ID NO: 329822 - DNA, 572 bp, Homo sapiens
  misc_feature: GZ8MTXP01C0EA2.45.86.H09.1.454.CMB.2.raw
  modified_base (289)..(289): a, c, t, g, unknown or other
  misc_feature (289)..(289): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctctgaatactaatggatacaactattggattggtatctgcagaagcaggcagtcnctcagctcctgattctagtttgggtctggacgtccgggcccccgtccgggggtcctgacctaggttcaggtggcaggtggatcgaggcacagtatttacatgagaatacgagacgaaggtggagagtagaagggtagttgggtttcggttagtttagttaacgtggtctaagtgtacgtaaagggtttacgtacctaacttaaccctttaagttacgttttggacccgtaggggaccaaggttcttagggaagtataacgaaacgacttggtaacggctaacg

SEQ ID NO: 329823 - DNA, 495 bp, Homo sapiens
  misc_feature: GZ8MTXP01BX5SK.45.86.H09.1.454.CMB.2.raw
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccctggagagccgctccatctcctgcaggtctagtcagagcctctgaatactaaatggatacaactattggattggatctgcagaagccaggcagtctctcagctctgatctatttggtcngatcggccctcgggtctgacnggttcagtgcgagtgatcaggcacanattactaactagagatagagagagagagagagagaggtgtgtgttagtatgnagtagtagtagttagtactactaacttacttacgttcgttcgacggacgacggcgttaggaagagtaacgaacgacgttagtgcgtg

SEQ ID NO: 329824 - DNA, 602 bp, Homo sapiens
  misc_feature: GZ8MTXP01B0F86.45.86.H09.1.454.CMB.2.raw
  modified_base (246)..(246): a, c, t, g, unknown or other
  misc_feature (246)..(246): n is a, c, g, or t
  modified_base (289)..(289): a, c, t, g, unknown or other
  misc_feature (289)..(289): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccctggagacgccgcctcatctcctgcaggtctagtcagagcctcctagaatactaanggatacaatattggattgatctgcagagccgaggcagtcctcncagctctgattcttagtttgggttctgacgtccggggtccccttcccgggggtcctgactaggttcagtggcaggtgactcgaggcactagtatttacacgtgaagatacgaggtacgaaggtaggacgagtaggagtaggttaggttggttacgtttaacgttacgtggtactagttacggtacgttaaagggtttacgaccttaacttaaccgtttaacgtttacggttttcggacccggttaacgggggtacccagggttccgttagggaagtaagttaaccgaaaaggtacgttggtcgttaacgtccg

SEQ ID NO: 329825 - DNA, 555 bp, Homo sapiens
  misc_feature: GZ8MTXP01EPQNJ.45.86.H09.1.454.CMB.2.raw
  modified_base (404)..(404): a, c, t, g, unknown or other
  misc_feature (404)..(404): n is a, c, g, or t
  modified_base (521)..(521): a, c, t, g, unknown or other
  misc_feature (521)..(521): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctctagaatactaaatggatacaattattggattggtatctgcagaagccgagggcagtctcctcagctctgattcttagtttgggttctgacgtccggggccccttccggggtcctggacctaggttcaggtggcaggtggactcgaggcactagtatttacataganaatcgagacgaagtggagagtagaggtaggttggttgggttactttaagttacgtgactagtagtacgttaaggtttctactacttaacttattacggtttcggacgtacggggacnggcgttaggaagataacgaagacgttgtggctcg

SEQ ID NO: 329826 - DNA, 543 bp, Homo sapiens
  misc_feature: GZ8MTXP01DBPNM.45.86.H09.1.454.CMB.2.raw
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (528)..(528): a, c, t, g, unknown or other
  misc_feature (528)..(528): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctctgaatactaatggatacaactattggattggtatctgacagaagccagggcagtctcctcagctcctgtacttctagttttgggtctgacgtccgggccccgtccggggtcctgactggttcagtgcagtggatcgaggcacagtattacactganagtcagcgaagngangtagagngttggttggtacgtttaagtctgctagtagcttaaagggtttcacttacttaacctttaattacgtttcggaccggtacgggaccttaggcgttagaagtaataacgaaaacgngttacggtgctaacg

SEQ ID NO: 329827 - DNA, 534 bp, Homo sapiens
  misc_feature: GZ8MTXP01B6XM3.45.86.H09.1.454.CMB.2.raw
  modified_base (439)..(439): a, c, t, g, unknown or other
  misc_feature (439)..(439): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgattcttagtttggttctgagtccgggccccctccggggtcctggactaggttcaggtggctaggtggatcgagggcacagtatttacactgagatcagcgagtgagctagaggtagtgttggtcgtttatactgcngtgcgtaaggttgtctcttcttattacgtttcggccgtacgggacgttgggcgttagggaagtacgtaacgaaacggtacttggtcggcgtaacg

SEQ ID NO: 329828 - DNA, 597 bp, Homo sapiens
  misc_feature: GZ8MTXP01EV2U0.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagacgcctcctagaatactaaatggaatacaacttatttggattggtatctgcagaagccagggcagtctcttagctctgatcttagttttgggtctgacgtccggggccgtccccggggtcctggactaggttcaaggtggcaggtggatcgagggcacgtagtactttacactgagaatcgaaggacgtaaaggtgggagtacgtaggaagggtagttggggttggttacggttttaattacgtgctagtgtacgtaaggtttacgtactaccttcctttaagtttaccgttttcgggacccggttaggggacccgtagggttcgttggaacgtaatacgaaacgtaagtggttaggtcgttgaacc

SEQ ID NO: 329829 - DNA, 617 bp, Homo sapiens
  misc_feature: GZ8MTXP01EIA51.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagacgcctcctagaatactaatggatacaactatttggattggtatctgcagaagccgagggcagtcctcctcagctcctgtattcttagtttgggttctggacgtccgggtccccgttccgggggtcctgactaggttcagtggctaggtgggactcgaagggctaactagttacttttacacgtagaagaatcgaagacggaaagtggagtaagtaggagggtagtttgggttcggttacgttttaagtaccgtggtactagtacgtacgtaaaggttttacgtacctacttcctttaagttacggttttcgggacccgtagggggtacccagggttcgttagggaacgtacgtaacggtaaacgtacgttggttcgcgtaaccgg

SEQ ID NO: 329830 - DNA, 593 bp, Homo sapiens
  misc_feature: GZ8MTXP01C07EG.45.86.H09.1.454.CMB.2.raw
  modified_base (292)..(292): a, c, t, g, unknown or other
  misc_feature (292)..(292): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttgggatattgtgatgactcagtctccactctccctgcccgtcacccctggagagccggcctccatctcctgcaggtctagtcagagcctcctagaatactaatggatacaactattggatggtatctgcagaagccagggcagtctcctnagtctcctgattcttagttgggttctgacgtcgggcctccccggggtccctggacgagttcgaaggtggctaggtggatcgaggcacgtagtattttacactagagtaatacgagacggaagtggagagtgaggtagttggggttggtcgtttattacgtgtcgagtgtacgtaaggtttacgtcttaccttccttaagttacgttttacgggtaccggacggggtaacccgtagggttacgttcgggagtaacgtaaccgtaaacggtaaccgtggttacggtaaccgttcggtaacccg

SEQ ID NO: 329831 - DNA, 637 bp, Homo sapiens
  misc_feature: GZ8MTXP01A1AI5.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctcctagaaatactaatggaatactaactatttggattggtatcgtgacagaacgccgagggcacgtcctcctcagctcctgtacttcttagtttgggtctgacgtccggggcccccgttccggggtcctggacgtaggttcaggtggacgaggtggatcgaggacacgtagtatttacacgtagaagaatcgagacggaaggtaggagtacgtagaggtaggttggtttagggttacgtttattacgtgtacgtagttacggtaacgttaagggttttacgtacttacctttaaccgtttaacgtttacggttttaccgggaccggtaacgggggtaaccgttagggttccggttaggaacgtaacgtaaccgaaacggtacgttcggtcggttaacgtcg

SEQ ID NO: 329832 - DNA, 627 bp, Homo sapiens
  misc_feature: GZ8MTXP01A8F20.45.86.H09.1.454.CMB.2.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctctagaatactaanggatacaatnttgattggtatctgcagaagccgaggcagtcctcctcagtctctgtattcttagtttggttctgtacgtccgggtcccccgttcccgggggtcctaggtaccgtaggttaccgaggtcgggctagggtgactcgaggctaacgtagttactttacgactagaataagtacgaagtcgtaagtggagtacgtaggtaggtaggttggttaggtacgtttacgtacgtggactagttacggtaacgttaaggttcgtacctaacgtttaacctttaagttaccgtttacgggaccggtaacgggtaccgttagggttcggttaggtaagtacgtaaccgaaacggtacgttaggtaacggttctaaccg

SEQ ID NO: 329833 - DNA, 578 bp, Homo sapiens
  misc_feature: GZ8MTXP01A62UT.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagagcctcctgaatactaatggatacaactatttggattggtatctgcagaagccagggcagtctcctcagctcctgattcttagtttgggttctgacgtccgggcccctccgggggtcctgacgtaggttcaggtgctaggtggatcgaggtcactagtatttacacgtagaagaatacgaggacgaagtggagacgtaggaggtagttggttaggtacgtttaagttacgtgacgtagtagtacgtaaggtttagtacctacttaaccttagttaccgtttcggaccgtaacggggtacccagggttcgttaggtaagactaacgaaacgtacgttgtcggctaacg

SEQ ID NO: 329834 - DNA, 490 bp, Homo sapiens
  misc_feature: GZ8MTXP01ASQ2U.45.86.H09.1.454.CMB.2.raw
  modified_base (319)..(319): a, c, t, g, unknown or other
  misc_feature (319)..(319): n is a, c, g, or t
  modified_base (386)..(386): a, c, t, g, unknown or other
  misc_feature (386)..(386): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaaatggatacaactatttggattggtatctgcagaagccagggcagtctcctcagctcctgatctattgggttcngatcggcccctccggggcctgacaggttcagtggcagtggatcaggcacagatttacatgagaatanagagagagagagagagagtgtgtgttattatgcatgacgtaagttagtctctcttacttattcgttcgacggacgagcgngaaganaacaacgacgagtgngtg

SEQ ID NO: 329835 - DNA, 522 bp, Homo sapiens
  misc_feature: GZ8MTXP01ESA8H.45.86.H09.1.454.CMB.2.raw
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (495)..(495): a, c, t, g, unknown or other
  misc_feature (495)..(495): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagagccggcctccatctcctgcaggtctagtcagagcctctgaatactaaatggatacaactattggattggtatctgcagaagccaggcagtctcctcagctcctgattcttagtttgggttctgacgtccgggcccctccggggtcctggacaggttcagtgctagtggatcgaggcacagtatttacatgagatcagcgagtgagangagngtgttggtacgtttatactgctatgagtaaggttatctacttccttattacgtttcggcgtaacggggaccaggcgttagggaanataacgaaacgacgttggtgcgtaacg

SEQ ID NO: 329836 - DNA, 588 bp, Homo sapiens
  misc_feature: GZ8MTXP01BQDJE.45.86.H09.1.454.CMB.2.raw
  modified_base (461)..(461): a, c, t, g, unknown or other
  misc_feature (461)..(461): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatcctcctgcaggtctagtcagagcctctgaatactaatggatacaactattggattggatctgcagaagccagggcagtctcctcagctcctgattcttagtttggtctggacgtccggggtccccgtccggggtcctgacctgggttcagggtcggctagggtggactcgagggcactagtactttacactgaagatacgagacgaagtggagacgtaggaggtaggttggttggtacgttagttacgngacgtagtgaacgttagggtttacacttacttaactttaagttacggtttcgggacccggtaaggggtaccaagggttcgttagggaatacgtaacgaaacggtacgttggtaacggttccgtaacg

SEQ ID NO: 329837 - DNA, 700 bp, Homo sapiens
  misc_feature: GZ8MTXP01B49EW.45.86.H09.1.454.CMB.2.raw
  modified_base (301)..(301): a, c, t, g, unknown or other
  misc_feature (301)..(301): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctctagaatactaatggatacaacttattggattggtatctgacagaacgcagggcagtcctcctnacgtctcctgtactttcgttagttttgggttctggtacgttcccgggggtcccccgttcccgggggttcctaggacccgtaggggtttaccagggttcggacgtagggttagggacttaccggaaggggtacctaaaccgttaaggtttaactttttaaccgaacggttaggtaaaggtaaactaccggaaagggtaacgggtaaagggtcgggaaacgtacggtagggtaacggggtaggtttaggggtttacgggtttaccgttttaagttaccgtgtactaggtagtacgttaagggtttactctaccgttaacttagttcgtttcggaccggtacggggtaccagggttcttagggaatacgtaacgaaaacggtcttcgggtcggttcctaacg

SEQ ID NO: 329838 - DNA, 637 bp, Homo sapiens
  misc_feature: GZ8MTXP01DL98H.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccgtggagacgccggcctccatctcctgcaggtctagtcagacgccctctagaatactaaatggaataactaacttatttggattggtatctgcaagaacgccgagggcagttcctcctcacgtcctcctgtactttcgttagttttcgggttctggacgtcccggggtcccccgtccggggtcctggacgtgggttacaggtcggcgtaggtggatcgaggcaactagttactttacagtagaacgtaatacgaaggacgtaaggtggaagtaggtaggtaggtagtttggttggttacgtttaagtactgacgtagttgtaacgttaagggtttactccttagtttaacctttaagttacggttttccgggaccggtaacgggggtaccttagggttcgttagggtaacgtacgttaacgaaacggtacgttgggtcgccgtaacg

SEQ ID NO: 329839 - DNA, 585 bp, Homo sapiens
  misc_feature: GZ8MTXP01BDSKF.45.86.H09.1.454.CMB.2.raw
  modified_base (417)..(417): a, c, t, g, unknown or other
  misc_feature (417)..(417): n is a, c, g, or t
  modified_base (544)..(544): a, c, t, g, unknown or other
  misc_feature (544)..(544): n is a, c, g, or t
  modified_base (570)..(570): a, c, t, g, unknown or other
  misc_feature (570)..(570): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggattccgtttggggatattgtgatgactcagtctccactctccctgccccgtcacccctggagacgccggcctccatctcctgcaggtctagtcagacgccctctagaatactaaatggataacaatattggattggtatctgacagaagccgagggcagtcctcctcacgctcctgtactttcttagttttcgggtctgtacgtccgggtccccgtccggggtcctaggactggttacaggtgcaggtggatcgagcacgtagttatttacagtagaanaaatcgaagacgtaaggaggagatagggaggtagttgggtttacggtcgtttaagtaactggactagtcgtactaagggtttctacctactttaacttacgtttacgtttcggacccggagggtacngggttcttaggaagataacgaaacgngttggtcgcgtaacg

SEQ ID NO: 329840 - DNA, 624 bp, Homo sapiens
  misc_feature: GZ8MTXP01DQBTT.45.86.H09.1.454.CMB.2.raw
  modified_base (479)..(479): a, c, t, g, unknown or other
  misc_feature (479)..(479): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagagcctctgaatactaatggatacaatattggattggtatctagcagaagccgagggcagtctcctcagctcctgatttcttagtttgggttctggacgtccggggtcccccgtccggggtcctgacgtaggttcaggtggctagggtagatcgagggtcaactagtattttacgactagagaatacgagacggtaagtaggaacgagtaggagggtaggttgggtttacggttagtttagttactggntagtagtacgttaaggtttaacgtcctaacttaacccgtttaagttaccgttttacgggttccgtaacgggggtacccgttaagggttccgttaacgggtaagtaacgtaaccgtaaaacggtacgttggtaacgggttcgtccg

SEQ ID NO: 329841 - DNA, 730 bp, Homo sapiens
  misc_feature: GZ8MTXP01CLFSQ.45.86.H09.1.454.CMB.2.raw
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggattccgtttggggatattgtgatgactcagtctccactctccctgcccgtcaccctggagacgccgcctcatctcctgcaggtctagtcagacgtcctctagaaataactaagtggaataactaacttagtttgattggtatctagacgaagaacgcgaggcacgtctccncacgtctctagtactttcgttagtttcggttctacggtacggttcccggggtccccccgttccgggggttacctaggtaaccgtaggttaaacgnggttcggacgtagggtaggacgtcgaacgggtacaacgtaaagtttactttaaccgaagttaggaaaatactaaccggaagggtaacggtaaagggtaccgggagtaaacggtagggtaagggttaggtttaggggtttaaccggggtttactttaaagttccgtagtaccgttagttaaccgggtagtttaaaacccgggttttcttaccgttaaccgtttaaccgtttaaggtttccgggttaacgggacgggtaacgggtaccgagggttcgttaaggaaacgtaactaaacggtaacggtcggttacgtcgttaacgtaacg

SEQ ID NO: 329842 - DNA, 644 bp, Homo sapiens
  misc_feature: GZ8MTXP01DTTG6.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactcctccctgcccgtccaccctggagacgcccggcctccactctcctgcaggtctagtcagacgtcctcctagaataactaataggaataacaacttagttggattggtatctgacagacgccgaggcagtctcctgacgtctctgtacttcgtttagtttgggtctggtacggtccggggtcccgttcccccgggggttcctaggtacgtacgggttcgaagggttcggcgtagggtacggactacgacgggctaaacgtagttactttacacgtagaacgtaatcgaaggaggtaaggtaggacgtaagtaggaaggtagtttggggggtttagttacgtttaatacgtcgactgtcgtaacgttagttcgtactctttacgttaagtttcgttcgggaccggttacggggtaacctgggttacgttgggaactaacgtaaacgtaaccgtagtggttacgtcgcggtaacc

SEQ ID NO: 329843 - DNA, 654 bp, Homo sapiens
  misc_feature: GZ8MTXP01B73CV.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccccgtggagacgccgcctccatcctcctgcaggtctagtcagacgcctctagaatactaagtggaatacaattattggattggatctgcaagaacgccgaggcagtcctcctcgacgtcctctagtacttcgttagtttgggtctggacgtccgggtcccccgttccggggtcctagacgtaggttcaggtcggactagggtgatacgacgggctaacgtagttactttaacacgtagaacgtaactacggaagacgtaaggtggaagtagtagggaaggttagttgggtttaggttacgttttaagtctggtactagttacgtacgttaaagggtttacctacttacccgtttaacgtttaacgtttacggtttcgggacccggtaaggggtaacccgttagggttcgttaagggtaacgtaacgtaacggtaaaacggtcgttaggtaacggttcggtaaccg

SEQ ID NO: 329844 - DNA, 549 bp, Homo sapiens
  misc_feature: GZ8MTXP01DEB1J.45.86.H09.1.454.CMB.2.raw
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (400)..(400): a, c, t, g, unknown or other
  misc_feature (400)..(400): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagagcctctgaatactaaatggatacaactattggattggtatctagcaagaacgcagggcagtcnccgtnagctcctgtattctagttttcgggtctggactccggggtcccccttccgggggtcctggactaggttcaggtggctagtggatcgaggcacagtatttanactgagaatcagagagtgagatgagtagtgttgtattacgtatgntatagctaaaggtttntactactaacttagttacgtttacggacggtacgggtacgacggttcgttaggtaagtactaacgaaacggtagttacggtcgcgtcg

SEQ ID NO: 329845 - DNA, 496 bp, Homo sapiens
  misc_feature: GZ8MTXP01BEJ28.45.86.H09.1.454.CMB.2.raw
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (420)..(421): a, c, t, g, unknown or other
  misc_feature (420)..(421): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgccccgtcacccctggagagccggcctccatctcctgcaggtctagtcagagcctctagaatactaatggatacaactattggatggtatctgcagaaacgccaagggcagtctcctnagctcctgattctattttgggtctgatcgggcctcccggggtcctgacngtcaagtgnagtgatcagcanagatttanactgaanananagagagagagagagagagtggttgtagttattatnntatagagtaagttagtactactcttaattacgttcggtacgaggacgagngngagaanacaacgagtgngcgngc

SEQ ID NO: 329846 - DNA, 569 bp, Homo sapiens
  misc_feature: GZ8MTXP01D6CJI.45.86.H09.1.454.CMB.2.raw
  modified_base (295)..(295): a, c, t, g, unknown or other
  misc_feature (295)..(295): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgccccgtcacccctggagagcccggcctccatcctcctgcaggtctagtcagagcctcctagaatactaatgatacaatattggatggtatctgcagaagccgagggcagtctcctnagctctgtattcttagtttgggttctgacgtccggggtcccgtccccggggtccctagacgtaggttcaagtggcagtgatcaggcacgtagtatttacactagagaatcgaagacgaaggtggaagagtaggaggtacgttggggttggtacgttttatactgtactagtgtacgttaaggttactctacttcttaattcgtttggaccgaggggtaccgagggttcgttgggaacgtaataacgtaaacgtacgtggacggtcttcggaacc

SEQ ID NO: 329847 - DNA, 629 bp, Homo sapiens
  misc_feature: GZ8MTXP01EVTSE.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagacgcctcctgaaatactaatggaatacaactagtttggatggtatctgcagaagccagggcagtctcctcagctcctgattcttagttttgggtctggacgtccggggcccttcccccgggggtccctaggacgtagggtttccaaagggttcggcgtagggttgggactcgaagggcacgtaagtatttacatagagaatcgagacgaagtggagacgtggagtagttggggttacggttacgttttaagttacgtaggtctaagttgtaacgttaaggtttacgttacctaactttccttaagtttaacgttttcgggaccggttacgggggtaccagggttacgttgggaacgtaacggtaactaaacggtaacgtggttacggtccgttggtaacccg

SEQ ID NO: 329848 - DNA, 612 bp, Homo sapiens
  misc_feature: GZ8MTXP01ENMX9.45.86.H09.1.454.CMB.2.raw
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (463)..(463): a, c, t, g, unknown or other
  misc_feature (463)..(463): n is a, c, g, or t
tcagacgcgatcgacacgaccggtgctcgatttagtgctatagacttgggtttggggtggtcaggactcctcagttcaccttctcacaatgaggctccctgctcagctccgtggggctgctaatgctctgggtctctggattccgtttggggattattgtgatgactcagtctccactcctccctcgcccgtccaccccgtggagacgccgcctccatcctcctgctaggtctagtcagacgccctctagaaactaactaaagtggaactaactaaattagtttaggattggtattcagacgaaaggacgccgagggacagtcctctcagtccttctagtactttgtttagtttgggtctgacgtccggggtccccgtccgggtcngtaccgtaggttcaggtcggnagggtgatcgagcaagtagttactttacgagtggaataagacgaggtaagaagggnggagtagtaggtaggttaggttcggtttaggttactttagtacgtgacgtagtacgtaagttaacggttactcttacttaacttagttacgtacggacggtacggtacgaggttgttaggaatacgtaagaacgtgttagtcgcgtaag

SEQ ID NO: 329849 - DNA, 617 bp, Homo sapiens
  misc_feature: GZ8MTXP01BPN15.45.86.H09.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagacgcctcctagaatactaatggatacaattattggattggtatcngcagagcaggcagtcnctcagctcngtacttcttagtttggtctgtacgtccggggtcccccgtccggggtcctggaccgtaggttaccaggtggctagggtcggatcgacggacactagttactttacgataggaacgtaatacgaggtacggtaaggtaggaagtacgtaggagggtaggttgggtttagggttacgtttagtacgtgtactagtacggtaacgttaaggtttacgtcctaactttctttaacgttacgtttacgggaccggtaacggggtaccttagggttcgttagggaagtaacttaacgaaaccggtacgttgggtcgaactccg

SEQ ID NO: 329850 - DNA, 669 bp, Homo sapiens
  misc_feature: GZ8MTXP01BO4DL.45.86.H09.1.454.CMB.2.raw
  modified_base (412)..(412): a, c, t, g, unknown or other
  misc_feature (412)..(412): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcagtctagtcagacgtcctctagaatactaatggatacaacttagttggatggtatctgacgagaacgccgagggctagtcctcctcagtccttcctgtagtttctttaggttttcgggtttctcggtcgttcccgggggtcccgttcccccgggggttcccctaggtaacccgttagggttaccaaggggttccgngtaaggttcgggacttacgacggactacgtaagttactttacgagttaggaataagcgaaggaacggtaggttagggaataaggtggaggttagttggggttaaggttccgttagttacgtgtacgtagttacgtaacgttacggttctaccttactttcgttaagtttcggttacggtaccggacgggtaccgtaggttacggttaggaacgtaacgtaacgtaaacgtgtcgggttacgtaacgttaacgtaacg

SEQ ID NO: 329851 - DNA, 604 bp, Homo sapiens
  misc_feature: GZ8MTXP01A9KJW.45.86.H09.1.454.CMB.2.raw
  modified_base (300)..(300): a, c, t, g, unknown or other
  misc_feature (300)..(300): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctcatctcctgcaggtctagtcagagcctcctagaatactaatggatacaactatttggattggtatctgcagaagccgagggctagtcctcctnagcctcctgtattcttagtttcgggttctggacgtccggggccccccgttccgggggtcctggaccgtaggttcaggtggcaaggtggatcgaggcacagttactttacacgttagagaactcgaggagaaggtcggaagtagtagagggtagttcggttgggttacgtttaatcgtggtactagtccgtagtaaggtttactctacttaacccgtttattcggtttaacggccggtaaacggggaccgttagggttcgttaggaacgtctaaccggaaacgtacgttaggtcgggttccgtcg

SEQ ID NO: 329852 - DNA, 649 bp, Homo sapiens
  misc_feature: GZ8MTXP01AHVYV.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtcctccactctccctgcccgtcacccctggagacgccggcctccatcctcctgcaggtctagtcagacgcctcctagaatactaagtggataacaactattggattggtatctgcagacgccgaggcagtcctcctcagtctcctgtacttcgtttagtttgggttctggtacgtccgggggtcccccttccgggggtcctggaaccgtggttacaggtggcgaggtggactgaggcaactagtactttacacgtagagaatacgagaggaaggtaggagtacgtggaggtagttggtttacggggttacttttacgtacgtcggtataagttcgtaacggtttaagggtttaaccgttccgttactttaaccgttttacgtttacgggttttacggacccgggtaacgggggtaacccaggggttcggttaacggaagtaacggtaaccgaaaacggtccgttagggtcgttaacgtcccgg

SEQ ID NO: 329853 - DNA, 515 bp, Homo sapiens
  misc_feature: GZ8MTXP01AK426.45.86.H09.1.454.CMB.2.raw
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaactattggattggtatctgcagaagccaggcagtcncctcagctctgatctagtttgggtctgacgtcggggcccctccggggtactggacnggttcagtgcaggtggatcaggcacagtatttacatgagaatacgagagagngagagngtagaggtgttggtcgttattactgcgatagacgtagttaagtctctccttattacttaggttcgacgggacgacggcgttgaaggtaagaacgaacgtagttgtcgcgtcg

SEQ ID NO: 329854 - DNA, 680 bp, Homo sapiens
  misc_feature: GZ8MTXP01ACDFF.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactcctccctgcccgtcaccccgtggagacgcccggcctccatcctcctgcaggtctaggtcagacgtccctctagtaatactaagtggaattacaacttgttggattggtactctgacagagccgtaggctagtcctctcgacgtcctccgtgtaacttcgtttaaggtttcggttctacggaccggttcccggggtcccccgttccggggtcctaggtaccggtagggttacccgaggttccgggagtaaagggtcgggtactacgggacggactaaacgtaagtttactttaacacgttagaacgtaacgtacgaacggtacggtaaggtaggacgtaagtaggtaggtaggttggttacggtttacgtttaacgttccgtgtcgtacgttacggtaacgtttacggttacgtaccttaccgtttaacttcgtttacggtcggacggtacgggaacgttggacgttagggaactacgtaacgaaaacgtcgcgtaagcgtaaccg

SEQ ID NO: 329855 - DNA, 634 bp, Homo sapiens
  misc_feature: GZ8MTXP01B4ZHG.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgcccggcctccatcctcctgcaggtctagtcagagcctctagaatactaatggatacaactattggattggtatctgcaagacgccgagggctagtcctcctcacgtcctcctagtatttcgttagttttgggttctggtacgtccgggggtcccccgttcccgggggtaccttggaaccgtagggtttccagggttcggacgtagggtcgggatcgagggaccaacgtagttatttacacgtagaagaatacgagacggtaagtggagacgtaggaggtaggttggtttaggtctttatacgttgctagtagtacgtaaggtttacgtctacctttaacttagtttacggtttcgggaccggtaacggggtaccgttaggccggttagggaacgtacgttaaccgaaaacggtgttacggtaacgttcgtaacg

SEQ ID NO: 329856 - DNA, 702 bp, Homo sapiens
  misc_feature: GZ8MTXP01EFR64.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgtgtctctggattccgtttggggatattgtgatgactcagtctccactcctccctcgcccgtccacccgtggagacgcccgcctccatcctcctgcaggtctagtcagacgtcctactagaattactaagtcggataactaattagttgattgtatcgtgacagaacgccgagggctacgtctccctcgacgtccttccgtagttactttacgtttaggttttcgggtactcggtccggttcccccgggggtccccggttacccgggggtccctaaggtaccccggttaagggtttaccgaagggttcggaccgttaggtcggtacgtcgacgggtacctacgtaaggtttaactttaaccgagttagaagtactacggaagaggtaagggtagaacggtagtagggacggggttagttcggggtttacgtagttttaagtaccgtgtataaacgttgtaacttaagggtttctacctaacgttttcttacggtttacggttcggaaccggtaacgggttaccgttaggactaagggaactaacgtaacgaacggttgttaacgttcggtaacc

SEQ ID NO: 329857 - DNA, 664 bp, Homo sapiens
  misc_feature: GZ8MTXP01ECQYO.45.86.H09.1.454.CMB.2.raw
  modified_base (537)..(537): a, c, t, g, unknown or other
  misc_feature (537)..(537): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactctccctgccccgtcaccccgtggagacgcccggcctccatcctcctgcaggtctagtcagacgccctctagaaatactaagtggaataactaacttagttggattggtatcgtagacaagaacgccgagggctagttcctccgtcagtccttcctagtactttcgtttaggtttcgggttctggtacggtcccggggtcccccgttccgggggtacctaggtaccgtacggttaccgagggtcggacgtagggtcggactccgaagggtactaacgtagtttaactttaacgagtagaacgtaatacggagacggtagtacggagtacgtaggtaggtagttggttaggttactttagtcgngtacgtagtacgtagttaaggttactaccgttactttaactttagttacgggtttcggaccgggtacgggtaccgaggttcgttaggaacgtaagtaacgaacggtacgttgggtcgttcgtaaccg

SEQ ID NO: 329858 - DNA, 691 bp, Homo sapiens
  misc_feature: GZ8MTXP01BF0ZI.45.86.H09.1.454.CMB.2.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagacgcctcctagaatactaatggatacaactnttgattggatctgcagagcagggcagtctctnacgtctccgtgtacttcttagtttgggttctggtacgtccggggcccccttccgggggcctgacgtaggtcaggtcggactagggtggactcgaggtcactagttactttacaacgtaggaacaagtaccgaagggaccgtaaaggtacgggaacgtaacgtagggtaagggtagtttcggggtttaggggttaacctttttagtaaccgttggaacgttaacgttaggttaaacggttaaacggggttttaaacgttcccctaacttttaaccccgtttaaagttttcccggtttacggggacccgggtaaagggggtaacccttaagggggccgttaagggggaactaacgttaaccgtaaaacgggtaaccgttcgggttaacgggcgtaaccg

SEQ ID NO: 329859 - DNA, 737 bp, Homo sapiens
  misc_feature: GZ8MTXP01EZBB9.45.86.H09.1.454.CMB.2.raw
  modified_base (284)..(284): a, c, t, g, unknown or other
  misc_feature (284)..(284): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggattccgtttggggattattgtgatgactcagtctccactcctccctgccccgtcaccctggagacgccgcctccatcctcctgctaggtctagtcagacgcctctagaaatactaaatggaactactaattattggattggtatcngacagaacgccgaaggctacgtcctcctcacgtcctccgtagtactttcgtttaggttttcgggttctacggtacggttcccggggtcccccccgtttcccgggggttcctaggtaccggttcgggttaccgagggttcgggaccgtaaggggttcgggaacttacgaacgggtactaaacgtaagtttaactttaacgacgtaggaaacgtaatacggaaaggtaggtaagggtaggtaacgacgttagggaggttagggttgggtttacgggttacttttaacgtagtcgtacgtagttacggtacgtttaagggtttacctaccgttacgtttaacgtttaacgtttacggtttcgggaaccgggtaaacggggtaccgttagggttcgttacgggtaaagtaaccgtaaacggtaaaacggttcggttagggttaacggttccgtaacg

SEQ ID NO: 329860 - DNA, 581 bp, Homo sapiens
  misc_feature: GZ8MTXP01A7BF6.45.86.H09.1.454.CMB.2.raw
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
tcagacgcgatcgacacgaccggtgctcgatttagtgctatagacttgggtttggggtggtcaggactcctcagttcaccttctcacaatgaggctccctgctcagctcctggggctactaatgctctgggtctctggatcctttggggatattgtgatgactcagtctccactctccctgcccgtcacccctggagagccggcctccatctcctgcaggtctagtcagagcctcctgaatactaatgatacaatnttggatggatctgcagagcaggcagtctctnagctctgatcttaagtttcggtntcgtagtccggcctccccggggtcctagacgtaggtctaagtcggcgtaggtcgactcgaagacaagtagtaactttacagtagagtaatagaagacgtaagtaggagtagtaggagtagttggggttacggtacgtttacgtacgtagtactagtagtaacgttaaggttacgtacctacttacttaacgttacgttacggtacggttacgggtaacgtacggttcgttaggagaactacgtaaacgacgtcggttcggtcgttcgtaac

SEQ ID NO: 329861 - DNA, 709 bp, Homo sapiens
  misc_feature: GZ8MTXP01AF9X8.45.86.H09.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtcctccactcctccctcgcccgtccaccccgtggacgacgcccggcctccatcctcctgcaggtctagtcagacgtccctctagaatactaagtgataacaattattggattgtatcgngcaagacgcgaggcagtccnctcacgtctcgtagtattcgtttaggtttcggttacgtggtacggttcccggggtcccccgttcccgggggtactaggacgtcggttaacgaggtcggctagggtgtactcgacgggactaacgtagtttaactttacgtacgtaacggtaagtaactacggtaaaggaccgggtaaagggtggaacgtaagtaggggtaaagttggggtttacggttgggtttaatttacgtacgtcgtaagtaggttacttaacggttaacggtttactaccttacgtttaacctttaaggtttacggtttaccgggaaaccggggttaaccgggtaacccgagggttccgaacgggttaagtaacgttaaccgaaacgggttaaccgttgggtaaccgggttctaacccg

SEQ ID NO: 329862 - DNA, 701 bp, Homo sapiens
  misc_feature: GZ8MTXP01C8EGN.45.86.H09.1.454.CMB.2.raw
  modified_base (181)..(181): a, c, t, g, unknown or other
  misc_feature (181)..(181): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactctcccngcccgtcaccccgtggagacgccgcctccatcctcctgctaggtctagtcagacgtccctactagtaaacttactaaagtggtaactaacgtaacttagttggattaggtacttctagacaggaacgccgagggaccagttcctcgtcagccttccgtagtactttcgtaggttttggtacctggtacgtcccggggtaccccggttcccggggtcctgtaccggtaggttaaccgaggtggggactagggttacggaatccggaggtacctaaacgttagtttactttaaccgaagtaggaagtaacgtacgaggtaggaaggtcgaaagtagtagggtagtaggtttcgggttgtttaccgtttataccgtgtacgtagttaccggtagttaacggtttactacctttactttaacgtttaacgttcccggtttaacgggccgggttaacggggccgttaaggttcgttaacggtaacgtacgtaacgtaaacggtggttcgtaaccggttctaaccg

SEQ ID NO: 329863 - DNA, 680 bp, Homo sapiens
  misc_feature: GZ8MTXP01A4MKU.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccctggagacgccgcctcatcctctgcagtctagtcagacgcctctagaatactagtggatactaatgttgattgatcgtagacaagaacgccgaggctagtcctctcgacgtctccgtagtacctttcgtttaggtttgggttcctaggtaccggtttcccggggtccccccggttacccgggggttacctaggtaccggttacggtttaaccgagggttcggtaccgtagggtacgggtactacgggaacgggtactaaacgtagttaacgttttaacgaacgtagtaaacgaagtacgaaggtacggtaaggtacggtaagcgtagtagggtaggttggttaggttacgtttagttacgtagtgtacgtagtaagttaacggttacttccgtaactttaacgtttaacgttacggtttacgggaccgtaaggggtacccttaggttcgttaggtaactaacgtaacgtaacggacgttgtcgaacgtcg

SEQ ID NO: 329864 - DNA, 493 bp, Homo sapiens
  misc_feature: GZ8MTXP02JQ3MA.45.86.H09.1.454.CMB.2.raw
  modified_base (292)..(292): a, c, t, g, unknown or other
  misc_feature (292)..(292): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaactattggattggtatctgcagaagccagggcagtctcctnagctcctgatctatttgggtctgatcgggcctcccggggtccctgacaggttcagtggcagtggatcaggcacagatttacatgagaatcagcgaagtggagactgaggatgtggcgtttatactgcatgactaaggttagtcactccttatactttggcctaggggaccaggctggagaatacaaacgactgtggctgac

SEQ ID NO: 329865 - DNA, 585 bp, Homo sapiens
  misc_feature: GZ8MTXP02JCDE9.45.86.H09.1.454.CMB.2.raw
  modified_base (345)..(345): a, c, t, g, unknown or other
  misc_feature (345)..(345): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctctgattctagtttggtctgagtcgggcccctccggggtccctgacnggttcagtggcagtggatcgaggcacagtatttacactagagaatcaggacgaaaggtgggagacgtaggaggtagttggtttagggtacgttttaagttaacgtggactagtggtaactaaggttttacgtactaacctttccgtttaagttacgttttcggaccggtaacggggtcccaaagggtccttagggaagtaacttaacgaaaaccggtaacgttaggtcgggaccttacgg

SEQ ID NO: 329866 - DNA, 546 bp, Homo sapiens
  misc_feature: GZ8MTXP02F4GZH.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatctagtttgggtctgatccggggccctccggggtccctgacaggttcagtggcaggtggatcgaggcacagtatttacactgagaatacagacgaagtggagacgtaggaaggtagttggttaggtcgtttaagttactgtacatgtacgtaaggtttacgtactacttactttattacgttttcggaccgtaggggaccgaggcgtaggaagacgtacgaaaacgacgtggtacggctacg

SEQ ID NO: 329867 - DNA, 546 bp, Homo sapiens
  misc_feature: GZ8MTXP02IUKNS.45.86.H09.1.454.CMB.2.raw
  modified_base (348)..(348): a, c, t, g, unknown or other
  misc_feature (348)..(348): n is a, c, g, or t
  modified_base (464)..(464): a, c, t, g, unknown or other
  misc_feature (464)..(464): n is a, c, g, or t
  modified_base (514)..(514): a, c, t, g, unknown or other
  misc_feature (514)..(514): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactcctccctgcccgtcacccctggagagccggcctccatctcctgcaggtctagtcagagcctcctgaatactaatggatacaacttattggattggtatctgcagaagcccagggcagtctcctcagcctcctgattcttatttgggtctgagtcgggcctcccggggtccctgacnggttcagttgcagtggatcgaggcacgagtatttacactgaagaatcgagcgaagtggaagacgtgaggtatggttaggttacgtttattacgtgactagtgtagtaaaggtttanactacttccttattacgtttaggaccgtacgggaccaggtctagggtaanaacgtaacgaaacgtacgtgtcgtactacgac

SEQ ID NO: 329868 - DNA, 550 bp, Homo sapiens
  misc_feature: GZ8MTXP02HT1XC.45.86.H09.1.454.CMB.2.raw
  modified_base (290)..(290): a, c, t, g, unknown or other
  misc_feature (290)..(290): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatgatacaactattggattggtatctgcagaagccaggcagtctcctnagctctgatcttagttggtctgactcgggcctcccggggtcctgacaggttcagtggctagttggatcgaggcactagtatttacactgaagatcagacgaagtggagactgaggtattggttggttcgtttattacgtgctatgacgtaaggtttacgtactacttactttacttacgttttcgggaccgtaacgggggtaccaagggtccgtagggagtaacgttaacgaaaacgtaacgtggttacggcttcgaacc

SEQ ID NO: 329869 - DNA, 556 bp, Homo sapiens
  misc_feature: GZ8MTXP02JZCKL.45.86.H09.1.454.CMB.2.raw
  modified_base (348)..(348): a, c, t, g, unknown or other
  misc_feature (348)..(348): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatcttatttgggttctgacgtcgggcccctccggggtcctgacgnggttcagtggcaggtgatcgaggcacagtatttacacgtgaagaatcgagacgaagtaggagacgtaggaggtatgggttggtacgtttattacgtgctagtgtacgtaaggtttacgtctacttaccgttattacgtttcggaccgtacggggtaccgagggcttagggaacgtaacgtacgaaaacggtacgtaggtacggctacg

SEQ ID NO: 329870 - DNA, 562 bp, Homo sapiens
  misc_feature: GZ8MTXP02IG12P.45.86.H09.1.454.CMB.2.raw
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaaatggatacaacttatttggattggtatctgcagaagccagggcagtctcctcagctctgatctatttgggtctgatcgggcctccccggggtcctgacnggttcaggtgcagtggatcaggcanagatttacatgagaatcagcgaagtgagactgagagttgttggtacgtttattacgtgctagtagcgtaaaggtttagtctacttacctttaagtttacgttttacgggaccgttaacgggggaacccgtagggtaccgttagggaacggtaactaacgaaaacgtaacgtggttacgggtactcggtaacccg

SEQ ID NO: 329871 - DNA, 541 bp, Homo sapiens
  misc_feature: GZ8MTXP02HXPSW.45.86.H09.1.454.CMB.2.raw
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctctgaatactaatggatacaactattggattggtatctgcagaagccagggcagtcnctcagctctgatctatttggtctgatcggccctccggggtccctgacgtaggttcagtggcagtgatcgagcanagtatttacatganaatcagacgaagtggagactagaggtatggtttggtgtttatacgtgntagtagtacgtaaggttagtactacttacctttacgtttacgtttacgtacggtacgggacgtaacggtcgtaggtaaggagttaacgtaaacgaaacgtacgtaggtacgtcg

SEQ ID NO: 329872 - DNA, 508 bp, Homo sapiens
  misc_feature: GZ8MTXP02FULOL.45.86.H09.1.454.CMB.2.raw
  modified_base (501)..(501): a, c, t, g, unknown or other
  misc_feature (501)..(501): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactatttggattggtatctgcagaagccagggcagtctcctcagctcctgatctatttgggtctgatcgggccctccggggtcctgacaggttcagtggcagtggatcaggcacagtatttacactgagaatcagcgaagtggagactgaggatgttggcgtttattactgcatgactaaggtttagtcacttccttattacgttttggaccgtaggggaccaggctggaagatacgaaacgactgnggctacg

SEQ ID NO: 329873 - DNA, 560 bp, Homo sapiens
  misc_feature: GZ8MTXP02G3YUL.45.86.H09.1.454.CMB.2.raw
  modified_base (398)..(398): a, c, t, g, unknown or other
  misc_feature (398)..(398): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctcctgaatactaatggatacaactattggattggtatctgcagaagccgaggcagtctctcagctctgatctatttggtctgagtcggcccgtcggggtcctgacagttcagtgcagtgatcgaggcacagtatttacactgaagaatcgagtcgaaggtgganacgtggaggtatggttggtctttagtactgactatcgtacgttaaggtttacgtctacctttacgtttaacttacggtttacggccggtaacggggtacccgaggggtccgttagggaagtaacgtaacgtaaaacggtaaccgtcggttcgggacttacgg

SEQ ID NO: 329874 - DNA, 522 bp, Homo sapiens
  misc_feature: GZ8MTXP02FV5ZV.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatctagtttggtctgagtcgggccctccggggtccctgacaggttcagtggcagtggatcaggcacagtatttacactgagaatcagcgaagtggagacgtgaggatggttgtcgtttatactgctatgactaaggtttacgtctacttccttattacgttttcggaccgtaaggggccaaggtctaggaagtatacgaaacgtaacgtgtacggctcg

SEQ ID NO: 329875 - DNA, 581 bp, Homo sapiens
  misc_feature: GZ8MTXP02GMFK4.45.86.H09.1.454.CMB.2.raw
  modified_base (295)..(295): a, c, t, g, unknown or other
  misc_feature (295)..(295): n is a, c, g, or t
  modified_base (456)..(456): a, c, t, g, unknown or other
  misc_feature (456)..(456): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctnagctctgatctatttgggttctgagtccgggcccctccggggtcctgactaggttcaggtcggcaggtggatcgaggcactagtatttacactgaagtaatcgagacgaaggtgggagacgtaggaggtagttggtttaggtacgttttagttacgtgtanaagttgtacgtaagggtttactctactttaccgtttatttacgttttcggaccggtaacgggggtacctagggtcgttagggaagtacgtaaccgaaaacggtaaccgttggtcggtacttacgg

SEQ ID NO: 329876 - DNA, 548 bp, Homo sapiens
  misc_feature: GZ8MTXP02FZOQQ.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatctagtttgggtctgacgtcgggcccctccggggtccctgactaggttcagtggcaggtggatcgaggcacagtatttacactgagaatcgagcgaagtggagacgtagaggagtggttggtcgtttattactgactagtagtacgtaaggtttagtctacttaccttagttacgttttcggaccgtacggggaccgtagggcgtaggaagaacgtacgaaaacggtaactcggtacggctacg

SEQ ID NO: 329877 - DNA, 611 bp, Homo sapiens
  misc_feature: GZ8MTXP02J1ZNV.45.86.H09.1.454.CMB.2.raw
  modified_base (299)..(299): a, c, t, g, unknown or other
  misc_feature (299)..(299): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgccaggtctagtcagacgcctcctgaatactaatggatacaacttattggattggtatctgcagaagccgagggcagtctcctnagctctgatctagtttgggttctgtacgtccgggccccgtcccggggtcctgacgtaggtcaggtggctaggtggatcgacggcacagtactttacacgtagagaatcgaggacgtaaggtaggagacgtggaggtagtggttggtacgtttattacgtgtacgtagtcggtacgttaagggtttacgtacctaacgtttaccgtttaacgttaccggttttacgggaacccggtacgggggttaccgacggtacgtacggggtaagtaacgttaaccgaaaacggtaacgttcggtacggtcgttacccgg

SEQ ID NO: 329878 - DNA, 521 bp, Homo sapiens
  misc_feature: GZ8MTXP02JTOLE.45.86.H09.1.454.CMB.2.raw
  modified_base (292)..(292): a, c, t, g, unknown or other
  misc_feature (292)..(292): n is a, c, g, or t
tcagacgcgatcgacacgaccggtgctcgatttagtgctatagacttgggtttgggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcncagctcctgatctattggtctgatcggccctcggggtcctgacaggtcagtggcagtggatcgaggcacagatttacactgagaatcagcgaagtggagactgaggatggttaggcgtttatactgcagtgctaaggtttagtctacttacctttataacgttttcggacctacgggggtacccgagggcctagggaagacgtacgaaacgaacgtggtacggacgtcg

SEQ ID NO: 329879 - DNA, 552 bp, Homo sapiens
  misc_feature: GZ8MTXP02I80X2.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccgaggcagtcctcctcagctcctgatctagtttgggttctgatccggggcctccccggggtcctgacgtaggttcaggtggcgagtgggatcgagggcaactagtatttacactgaagaatcagcgaagtggacgagtgaggtattggttggtacgttttattacgtagcgtagtagacgtaaaggtttagtctacgttcctttaattacgttttggaccgtaggggaccaggcgtaggaagaagtacgaaaacgtacgtggtacgcgtagacc

SEQ ID NO: 329880 - DNA, 556 bp, Homo sapiens
  misc_feature: GZ8MTXP02HES1Z.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatctatttgggtctgatcgggcccctccggggtccctgacaggttcagtggcagtggatcaggcacagtatttacactgagaatcgagacgaagtggagacgtaggaggtagtggttggtacgtttagttacgtgactagtgtactaagggtttacgtactaccttaccttaattacgtttacggtaccggtacgggaccggtaacggtcgtaggtaaggataacgaaacgtaacgtaggtacggtacgtacg

SEQ ID NO: 329881 - DNA, 631 bp, Homo sapiens
  misc_feature: GZ8MTXP02HAGP0.45.86.H09.1.454.CMB.2.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactcctccctgcccgtcacccctggagacgcccggcctccatcctcctgcaggtctagtcagacgccctctagaatactaatgatacaatnttggattggatcngacagagccgaggcagtctcctcagctcctgtattcgttagtttcgggtctggtacggttccggggtccccccgttcccggggtccctaggtaccgttacggggttccaagggtcgggaccgtaagggtcggaacgttccgaagggacctaaacgtaagtttactttaaacgacgttaggaaagtaagtacgagggacggtaaaggtgggaagtacgtaggaggtagttggtttaggtactttagtactgactagtgtacttaaggttactctacttcttagttcgttcggaccggacgggaccgtaggtcgtaggaacgtacgtaacgtaaacgttacgttcggactacgtacc

SEQ ID NO: 329882 - DNA, 538 bp, Homo sapiens
  misc_feature: GZ8MTXP02GQ7Y7.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccagggcagtctcctcagctcctgatcttagtttgggttctgagtccgggccgtccccggggtcctgactaggttcagtgcagtggatcaggcactagtatttacactgagaatcagcgaagtggagacgtgagtagtgttggtacgtttattacgtgctatgtacgtaaagtttagtactacttaccttacttacgttttggccgtaagggggacctagggacgtagggagaagtacgaaaacgtacgtgtaggctgacc

SEQ ID NO: 329883 - DNA, 566 bp, Homo sapiens
  misc_feature: GZ8MTXP02GILJD.45.86.H09.1.454.CMB.2.raw
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactcctccctgcccgtcaccccgtggagacgccgacctccatctcctgcaggtctagtcagacgcctctagaatactaatggatacaactagtttggattggtatctgacagaagccgagggcagtctcctnacgctctgattcttagtttgggtcngtacgtccgggccccgtccggggtccagacgtaggttcaggtgcagtgatcgagcanagtatttacataganaatacgagagaagtgacgagtaggagtagttcggttagtacgttttaagtacgtagatagtacgtagttaaggttactactacttacgtttagttacggtttcggaccggtaacgggacctaggtcgtaggaagtaactaacgaaaacgtacgttgacggtctacg

SEQ ID NO: 329884 - DNA, 510 bp, Homo sapiens
  misc_feature: GZ8MTXP02HHPOP.45.86.H09.1.454.CMB.2.raw
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
tcagacgcgatcgacacgaccggtgctcgatttagtgctatagacttgggtttggggtcaggactcctcagttcaccttctcacaatgaggctccctgctcagctcctggggctgctaatgctctgggtctctggatcctttgggatattgtgatgactcagtctccactctccctgcccgtcaccctggagagccggcctccatctcctgcaggtctagtcagagcctctgaatactaatggatacaactattggattggatctgcagaagccaggcagtctctcagctctgatctagtttggtctgatcgggcctcccggggaccctgactaggttcagtggcagtgatcgagcangtatttacatgagaananagagagagagagagagtagtgttgtagttattatgagtatagtagtagttagtactactacttacttacgttacgtacgacggtacgacgacgtagagtaagtaacgaaacgtacgtagtacgtacgtacgacg

SEQ ID NO: 329885 - DNA, 678 bp, Homo sapiens
  misc_feature: GZ8MTXP02F62SR.45.86.H09.1.454.CMB.2.raw
  modified_base (257)..(257): a, c, t, g, unknown or other
  misc_feature (257)..(257): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcaccccgtggagagccggcctccatctcctgcaggtctagtcagagcctcctgaatactaatggatacaactnttggattggtatcgtgcagacgccaggctagtctccgtcgagctcctgacttcgtagtttgggttctaggacgtccggggtccttaccccggggtcccctaggaccgtagggtttcaggttcggcgtaggtacggacttcgacggtctaacgtagttactttacacgtagaacgtactcgacgtcgtaaaggttcggaacgtacgtggtaaggtagttggttacggtacgtttacgttacgtagtaccgtagttacggtacgttaacggtttacgtaccgtaccgtttacgtttaacgttaccggttttacgggacccggttaaacgggggtacccgtagggtacccgttagggtaaacggtaaccgttaaccggtaaaacggttaccggttacggtaccggttaccgtacggtaaacccg

SEQ ID NO: 329886 - DNA, 551 bp, Homo sapiens
  misc_feature: GZ8MTXP02I3SAH.45.86.H09.1.454.CMB.2.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctcctagaatactaatggatacaactatttggattggtatctgcagaagccagggcagtcncctcagctccngattcttagtttggtctgtacgtccggggccctcccggggtcctgactaggttcagtggcagtggactcgaggcacagtatttacactgagatcgagacgaagtgganacgtaggagtagttggttggtatttattacgngtntatgagttaggtttactctacttacttagttacgtttcggaccggtacgggaccgtaggtcgtaggaagtacgtaacgaaacggtaacgtgtacggctacg

SEQ ID NO: 329887 - DNA, 595 bp, Homo sapiens
  misc_feature: GZ8MTXP02G1TL9.45.86.H09.1.454.CMB.2.raw
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagacgcctcctgaatactaatggataacaactattggattggtatctgcagaagccagggcagtcncncagctctgatcttagtttgggtntgagtccgggtcctcccggggtccctgactaggttcagtggcagtggatcgaggtcaactagtatttacacgtgaagaatcgagacgaagtaggagacgtaggaggtagttggttcggttagtttagttacgtgactagtacgtacgttaaaggtttcgtactacttaccgtttaattacgttttacgggacccgtaacgggggaacccgaagggtccgtaggggtaaacgtaaacgtaaacgtaaaaccggtacgtaggtacggtaccgtacggaccg

SEQ ID NO: 329888 - DNA, 603 bp, Homo sapiens
  misc_feature: GZ8MTXP02IPF6N.45.86.H09.1.454.CMB.2.raw
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagagcctctgaatactaatggatacaactattggattggtatctgcagagccagggcagtctcctnagctcctgattcttagtttgggttctggacgtccggggtcccccgtcccggggtccctaggacgtagggtttccaggtcgggctaggtggatcgaggcacagtatttacatgaagaatcgagcgaagtgganacgtggaaggtagttggtttggtacgtttattaacgtgactagtcgtacgttaaggtttacgtactaacctttacgtttacgtttacgttttacggacccggtaacgggggtacccgtaacgggtccgtaagggaagtaacgtaaacgaaaaccggtaacgtcggtacggtctacg

SEQ ID NO: 329889 - DNA, 565 bp, Homo sapiens
  misc_feature: GZ8MTXP02HNS1E.45.86.H09.1.454.CMB.2.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactatttggattggatctgcagaanccagggcagtcnctnagctcngattctatttgggtctgatcgggccctccggggcctgactggttcagtgggcaggtgatcgagcacagtatttacactgataatcgagacgaaagtggaagacgtaggaggtattggtttaggtacgttttatacgtgctagtgtacgtaagggtttactactacgtttaccttaagtttacgttttacgggacccgtaagggggtacctaagggtccttagggaacggtactaacggtaaaacgtacgttggtacggtactcgg

SEQ ID NO: 329890 - DNA, 559 bp, Homo sapiens
  misc_feature: GZ8MTXP02IZHZ4.45.86.H09.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagccctctgaatactaatggatacaatattggattgatctgcagaagccaggcagtcncctcagctctgattcttagtttgggtctgacgtccgggccctccggggtcctgactaggttcagtggcagtgatcgaggcacagtatttacactagagaatacgagacgaagtggagacgtagaggtatggttggtacgtttatactgtactagtgtacgttaaggtttacgtactactttacgttatttacgtttcgggaccgtaacggggtaccgtacggtcgttaggaagtaacgttaacgaaaacggtacgtacggtcggtactacgg

SEQ ID NO: 329891 - DNA, 568 bp, Homo sapiens
  misc_feature: GZ8MTXP02IU49G.45.86.H09.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccctggagagccggcctccatctcctgcaggtctagtcagagcctctgaatactaatggatacaactattggattggtatctgacagaagccagggcagtctcctnagctctgattctagttggtcngacgtccgggcccctccggggtcctgactaggttcagtggcaggtggactcgaggcacgagtatttacacgtagagaatcgagacgaagtacgggagtacgtaggaggagttggttggtacgtttatacgtgatagtggacgttaaggtttagtctacttaccttagttacgtttcggaccgtaacgggggtaccctaaggggtccttaagggaacgtacgtaaccgaaaacggtaacgtggtacggctacgg

SEQ ID NO: 329892 - DNA, 636 bp, Homo sapiens
  misc_feature: GZ8MTXP02I5JE4.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatcctcctgcaggtctagtcagacgccctcctagaatactaatggatacaactattggattggtatctgcaagaacgccgagggcagtcctcctcacgcctccgtgtacttcgttagttttcgggttctggtacggttcccggggtcccccgttccccgggggtcccctggtaaccgtacgggttcgagggttcggggctagggtggactcgacggctacagttatttacacgtgaagaatcgaggacggaaggtgacgagtggaaggtagttggtttagggttacgttttagttacgtggactagtcgtaacgttaagggtttactactactttacgtttagtttaccgtttacgggaccggaacggggtacccgagggtcgtagggaacgtacgtaaccgtaaacggtaacgtggtacgtcgtacg

SEQ ID NO: 329893 - DNA, 581 bp, Homo sapiens
  misc_feature: GZ8MTXP02HOOR0.45.86.H09.1.454.CMB.2.raw
  modified_base (450)..(450): a, c, t, g, unknown or other
  misc_feature (450)..(450): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctctgaatactaatgatacaactattggattggtatctgcagaagccgagggcagtctcctcagctcctgattctagtttgggtctgacgtccggggccccgttccggggtcctgacgtggttcgagtggcaggtgatcgagcatagtatttaccatagagtaatcgagacgtaagtggagagtggaggtattgggtttggtacgtttaagttacgnggtactagtagtacgttaaaggtttactacgttactttacgtttacgtttacggtttacggaccggtaacggggtaccgagggtcgtagggaacgtacttaaacggaaaaccgtagtggtacggtctacgg

SEQ ID NO: 329894 - DNA, 575 bp, Homo sapiens
  misc_feature: GZ8MTXP02GNRWP.45.86.H09.1.454.CMB.2.raw
  modified_base (290)..(290): a, c, t, g, unknown or other
  misc_feature (290)..(290): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaatattggatggtatctgcagaagccagggcagtctcctnagcctcctgatcttatttgggttctgagtcgggcctccccggggtccctgactaggttcagtggcagtggactcgaggcacagtatttacactgaagatcagacgaagtggagacgtggaaggtagtggttggtacgtttaagttacgtgactagtagtacgttaaagggtttacgtacctacttacctttagttaccgttttacgggacccgtaacgggggtacccgacgggtacgtagggaagtaaacgtaacgaaaacgtaacgtggtacggctacggaccc

SEQ ID NO: 329895 - DNA, 602 bp, Homo sapiens
  misc_feature: GZ8MTXP02FXU68.45.86.H09.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (588)..(588): a, c, t, g, unknown or other
  misc_feature (588)..(588): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtcctccactcctccctcgtcccgtccaccccgtggagacgccggcctccatcctcctgcgtaggtctagtcagacgccctctagaatactaagngatacaattattgattgtatntgcagacgccgaggcagtcctcctnacgctctgacttcttagtttggtctgtacggtccggtcccccgtaccggggtcctgacgtggtcaggtgctaggtgatcgaggcaactagttactttacacgtagaacgtaatacgacggtagaaggtagggacgtaaggtaggagggtagttgggttagggttacttttaagtcgtgtactagtcgtaacgttaaggttagtactaccttactttacgttaccgtttcggaccggtacgggtaccgtaggtcgtagggaacgtacaaacgtaaaaccggtntaggtcggactccg

SEQ ID NO: 329896 - DNA, 580 bp, Homo sapiens
  misc_feature: GZ8MTXP02GTMLK.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatgatacaacttattggattggtatctgcagaagccagggcagtctctcagctctgatcttatttgggttctgacgtccgggtccgtccccggggtccctgacgtcgggtttcaggtcgggctaggtggactcgaggcaacgtagtaatttacacttagaagtaatcgaagacgaaggtaggaagacgtaggagggtagtaggttggtacgtttattacgtgctagtgacgtaaggtttagtactacttacctttagtacgtttacggaccgtacggggacctacggtacgtaggagtaacgtacgtaaaacggtacgtggtacggtacgtacgaccg

SEQ ID NO: 329897 - DNA, 512 bp, Homo sapiens
  misc_feature: GZ8MTXP02FSHGQ.45.86.H09.1.454.CMB.2.raw
  modified_base (345)..(345): a, c, t, g, unknown or other
  misc_feature (345)..(345): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagacgcctcctgaatactaatggaatacaactatttggattggtatctgcagaagccagggcagtctcctcagctctgatctagtttgggtctgagtcggccctccggggtcctgacnggtcagtgcaggtgatcgaggcacagtatttacactagagatcagcgagtgagagtgagatcggttgtcgtttatctgctagtgtacgtaggttatctacttcttattcgtttcggacgacgggaccgaggcgtaggaagtactacgaaacgacgtggtcgactacg

SEQ ID NO: 329898 - DNA, 608 bp, Homo sapiens
  misc_feature: GZ8MTXP02G1HL8.45.86.H09.1.454.CMB.2.raw
  modified_base (294)..(294): a, c, t, g, unknown or other
  misc_feature (294)..(294): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagacgcctcctgaatactaatggaatacaactattggattggtatctgcagaagccagggcagtccnctcagctctgatcttagtttgggtctgacgtcggccccgtccggggtcctgactggttcagtggcaggtggatcgagcacagtatttacactagaagaatacgagacgtaaaggtggaagtacgtaggaggtagttgggtttggtacgtttaagttacgtagtatagttggtacgttaaagggttttactaccttaacgtttacctttaacgtttacggttttacgggaccggtaaacgggggtacccgtagggaccgttaggggaaacgtaacgttaaccgaaaaacggtaccgttggtaacgggtcctacgg

SEQ ID NO: 329899 - DNA, 700 bp, Homo sapiens
  misc_feature: GZ8MTXP02IK8CU.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgcccggcctccatcctcctgcaggtctagtcagacgcctctagaatactaatggatacaactagttggattggtatctgacagaacgccgagggctagttcctcctcacgtcctcctgtattcgttagtttgggtctggacgttccggggtcccccgtcccggggtcctgtacgtaggttcgaggtcgggacgtaggtaggactcgaggacctaacgtaagttactttacgaacgttaggaaagtaaacgtacgaagggtacggtaaagggttacgggagtaacggtagggtaaaggttggtttacgggttttagggtacgtttttaacgtaccgttgtacgttaagtagggtaacgtttaaaggtttacgtaccgtaaccttttaccgtttaacgtttaccggtttacgggacccgggtaacgggggtaccgtacgggtaccggttaggaacgttaacgtaaaccggtaaaacggtacgttacgggtcggtaactaccgg

SEQ ID NO: 329900 - DNA, 579 bp, Homo sapiens
  misc_feature: GZ8MTXP02JJOI2.45.86.H09.1.454.CMB.2.raw
  modified_base (296)..(296): a, c, t, g, unknown or other
  misc_feature (296)..(296): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagcccggcctccatctcctgcaggtctagtcagacgcctcctgaatactaatgatacaactattggattggtatctgcagaagccagggcagtctcctnagtctcctgattcttagtttggtctgagtcgggccccgtccggggtccctgacgtaggttcagtggacaggtggatcgaggcactaagtatttaacacgtagagaagtacaggacgaaggtggagtacgtaggaggtagttggttgggtacgttttagttaacgtcgtacgtagtagtacgttaaagggtttacgtactaaccttaccgtttagttacgtttacggccgtacggggtaccaggtcgtaggaagacgtaacgaaacgtacgtggtacgacgtcg

SEQ ID NO: 329901 - DNA, 563 bp, Homo sapiens
  misc_feature: GZ8MTXP02FYEY5.45.86.H09.1.454.CMB.2.raw
  modified_base (294)..(294): a, c, t, g, unknown or other
  misc_feature (294)..(294): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagacgcctcctgaatactaatggatacaactattgattggatctgcagaagccaggcagtctcctnagctcctgattcttagttttgggtctgacgtccggggccccgtccggggtccctagacgtaggttccaggtggcagtggatcgagcacagtatttacacgtagagaatacgaggacgaaaggtggagagtaggaggtagtggttggtacgtttattacgtgctagtcgtagtaagtttacgtactacttactttacttacgtttacggacgacggggtaccgagggtcgtaggtaagacgtaacgaaaacggacgtacggtcggactcg

SEQ ID NO: 329902 - DNA, 574 bp, Homo sapiens
  misc_feature: GZ8MTXP02ILI1D.45.86.H09.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatgatacaacttattggattggtatntgcagaagccgagggctagtctcctnacgctctgattcgttagtttgggtctggacgtccggggtcctccccggggtccctgacgtggttcaggttcggcgtagtggactcgaggcagtagtatttacacgtgaanatacagcgaagtcggaagtacgtggtaggtagttggttggttacgtttagtacgtagactagtgtacgtaaggtttcgtactacttacttacgttacgtttacggaccgtagggaccgtaggtactggaacgtaacgtaacgaaacgtacgtgtcggtactacgtaccg

SEQ ID NO: 329903 - DNA, 579 bp, Homo sapiens
  misc_feature: GZ8MTXP02GP7X3.45.86.H09.1.454.CMB.2.raw
  modified_base (292)..(292): a, c, t, g, unknown or other
  misc_feature (292)..(292): n is a, c, g, or t
  modified_base (413)..(413): a, c, t, g, unknown or other
  misc_feature (413)..(413): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctagaatactaatggatacaactattggattggtatctgcagaagccagggcagtctcncagctctgatcttatttgggttctgacgtccggggtcctccccggggtccctgactaggttcagtggcaggtggatcgaggcacagtatttacactgaagatcgagcgaagtggaagacgngaggtattggttggtacgtttattacgtgactagtagacgttaaagggtttactaccgtaactttacctttaagtttacgttttacgggaccggtaacgggggaaccgaagggtcgtagggaagtaacgttaccgaaaaacgtacgttggtacggtctacggtacc

SEQ ID NO: 329904 - DNA, 564 bp, Homo sapiens
  misc_feature: GZ8MTXP02F9KEZ.45.86.H09.1.454.CMB.2.raw
  modified_base (419)..(419): a, c, t, g, unknown or other
  misc_feature (419)..(419): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcaagaagccaggcagtctcctcagctcctgattctagtttgggttctgacgtccggggccttccccggggtcctgactaggttcaggttcgggcgtagtgggatcgagggctaacgagtatttacatgaagaatcgagcgaagtgganacgtgaggtatggttggtcgtttattacgtgactagtgtacgtaaggtttgtactaccttcttaactttacgtttcgggaccgtaacggggtaccagggtccgtaggaacgaacgtacgaaaacgtacgtcgtcggactcgaacc

SEQ ID NO: 329905 - DNA, 562 bp, Homo sapiens
  misc_feature: GZ8MTXP02F79CN.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgattactcagtctccactctccctgcccgtcacccctggagagccggcctccatctcctgcaggtctagtcagagcctctgaatactaatgatacaatattgattgtatctgcagaagccagggcagtctcctcagctctgatcttagtttgggttctgagtccgggccgtccccggggtccctgactaggttcagtggctagtggatcgaggcactagtatttacactagaagaatcgagacgaaggtggaagactggaaggtatggttggtacgtttagttacgtgactagtgtacgtaaggtttatactacttactttagttacgtttacggccgtaacggggactacggtacgtaggaagaacgttaacgaaaacggtacgtggtacggtcgttacgaaccc

SEQ ID NO: 329906 - DNA, 653 bp, Homo sapiens
  misc_feature: GZ8MTXP02GYIKP.45.86.H09.1.454.CMB.2.raw
  modified_base (303)..(303): a, c, t, g, unknown or other
  misc_feature (303)..(303): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtccacccctggagacgcccggcctccatcctcctgcaggtctagtcagacgcctctagaatactaatggatacaactatttggattggtatctgcagaagccgagggcagtcctcctnacgtctcctgacttcgttagtttgggttctggacgttccggggcccccgttcccggggtacctgacgtaggttcaggtgggctaggtggatcgaggcactagtactttacactagagaatacgagacgtaaggtaggagtacgtagggtaggtaagttggtttacgggttacgttttacgttaacgtcgtactagttaggtacgttaaaggtttacgtaccttaaccgtttacctttaacgtttacggttttaccgggtaacccggtaacgggggtaaccgtacgggtaccgttagggtaaacgtaacgtaaaccggtaaaacgtacggttacggtcgggtacctaccgg

SEQ ID NO: 329907 - DNA, 573 bp, Homo sapiens
  misc_feature: GZ8MTXP02GPNR5.45.86.H09.1.454.CMB.2.raw
  modified_base (296)..(296): a, c, t, g, unknown or other
  misc_feature (296)..(296): n is a, c, g, or t
  modified_base (381)..(381): a, c, t, g, unknown or other
  misc_feature (381)..(381): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctcctgaatactaatggatacaactattggattggtatctgcagaagccgagggcagtctcctnagctcctgattcttagtttgggtctgacgtccgggccccgtccggggtcctgacgtaggttcaggtggcaggtggatcgaggcanagtatttacacgtagagtaatcgagacggaagtggagacgtaggaggtagttggttggtacgtttattacgtgtactagtgtacgttaaggtttacgtactacttacctttagtttacgtttcggacggtaacggggaccgtacggtcgtaggaagtacgtaacgtaaaacgtaacgtggtacggtcgtacg

SEQ ID NO: 329908 - DNA, 633 bp, Homo sapiens
  misc_feature: GZ8MTXP02HZ8OM.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatccgtttggggatattgtgatgactcagtctccactctccctgcccgtcaccctggagacgccggcctccatctcctgcaggtctagtcagacgcctctagaaatactaagtggaataactaaacttagtttggatttggtatctgacagaacgccgaagggctagtcctcctcacgtctcctagtattcttagtttgggttctgtacgtccggggccgttcccccggggtccctagacgtaggttcaggtcggcgtaggtggaactcgaaggacaacgtaagttaactttaacgacgtagaagtaaacgtacgaaggacgaaaggtggaaacgtagtaggaaggtagttggtttaggttacgttttatacgtgatagtagtacgttaaaggttatactacttactttacgttacgtttcggacgtaacggggtaccaggtcgtaggaacgtaacgtaaaccgtaaaacgtaacggtaggtcggtactacgacccg

SEQ ID NO: 329909 - DNA, 623 bp, Homo sapiens
  misc_feature: GZ8MTXP02HO5KR.45.86.H09.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagacgcctctgaatactaatggatacaactnttggattggtatctgacagaacgccgaggcagtctcctnacgctcctgatcgtttagtttcggttngtacgtccgggccgtccccggggtcccngtactagggttcaggttgctagtggactcgaggtcaacgtagtactttacacttagagaatcgaagacggaaagtcggagtacgtggaggtagttgggtttacggttacgtttagttacgtggtactagttacggtacgttaacggtttacgtaccgttaacttaccgttttacgttaccggttttcgggaccggttaaacggggaccgtaacggtccggttagggaactaacgttaaacgaaacgtaacgtggtacgacggtttcgacccg

SEQ ID NO: 329910 - DNA, 626 bp, Homo sapiens
  misc_feature: GZ8MTXP02G394L.45.86.H09.1.454.CMB.2.raw
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagacgcctcctagaatactaaagtggaataacaacttatttggattgggtatctgacagaagccgagggcagtccncctnagctctgattcttagtttgggtctggtacgtccgggccccgttcccggggtccctgacgtaggttccaggtgcagtgatcgagcacatatttacatagagtaatcgagacgaaggtggagacgtaggaaggtagttggtttaggttacgttttaagtacgttagactaaggttcgtaacgttaaaggtttacgtaccgtaactttacctttaaagtttccgttttacgggaccggtaaacgggggaccctaaggggtaccgttaagggaacgtaacgtaaaccgaaaaaccgtaacgttaggtcggtaccggtaccg

SEQ ID NO: 329911 - DNA, 559 bp, Homo sapiens
  misc_feature: GZ8MTXP02GN5DH.45.86.H09.1.454.CMB.2.raw
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggacgacgccggcctccatcctcctgcaggtctagtcagacgcctctagaatactaatgatacaattattgattggtatctgacagacgcgaggcagtcnccnagctctgacttcttagtttggtctgacgtccgggccccgtcccggggtcctaggacgtaggtcaggtggcgacgtaggtacgtcgacggacgactagtagttactacgagtagaatacgcgagacgtagagagtagaggtagttgttgttagttacgttagtcgagtatgtacgtagttagttactacgttacttacgttagttacgtacggacggtacgtacgagtacgaagtacaacgtaacgaacgtacgtagacgtacg

SEQ ID NO: 329912 - DNA, 622 bp, Homo sapiens
  misc_feature: GZ8MTXP02F3CI0.45.86.H09.1.454.CMB.2.raw
  modified_base (306)..(306): a, c, t, g, unknown or other
  misc_feature (306)..(306): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagacgccctctagaatactaatggaatacaacttagtttggatttggtatctgacaggaagccgagggcagtcctcctnagtctcctgattcttagttttcgggtctggacgtccggggccccgttccggggtccctggacgtggttcaggtggctaggtggatcgaggcacgtagttactttaacacgtagaagtaatacgaggacggaaggtagggagtaacgtagggtaaggtaggtttggtttacgggttacgttttaagttaccgtgtacgtagttacggtaacgttaagggtttactaccgtactttactttagttaccgtttcgggaccggtacgggacgtacggcgttaggaagtaactaacgaaacgtacgtaggacggtactacg

SEQ ID NO: 329913 - DNA, 667 bp, Homo sapiens
  misc_feature: GZ8MTXP02GQ7UN.45.86.H09.1.454.CMB.2.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactcctccctgcccgtccacccctggagacgccggcctccatcctcctgcaggtctagtcagacnccctctagaatactaagtggaatactaattatttggatttggtatctgacagaacgccgagggctagtcctcctnacgcctctgattcttagttttggtctggtacggtccgggtccccgtcccggggtccctaggaccgtaggttccgagggtcggacgtaggttaggactccgaaggcctaataaagttactttaccgaagtagaagtaagtacgaggacggtaaagtgggaagtaaggtggaaggttagttaggtttggttacgtttaagttacgtagtatagtggtaacgtttaggtttacgtaccttactttaccgtttaaacgtttccggtttccgggaaccggtacggggtaacccgtagggtaccggtaaggaaacggtaaaccgtaaacgtaaaaccgtacggtacggtcggtacgtaacg

SEQ ID NO: 329914 - DNA, 604 bp, Homo sapiens
  misc_feature: GZ8MTXP02H5JMT.45.86.H09.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggattcctttggggatattgtgatgactcagtctccactctccctgcccgtccacccctggagacgccggcctccatcctcctgcaggtctagtcagacgcctctagaatactaatgatacatattggattgtatntgacagaacgccgagggctagtctcctcagtctcctgattcttagtttgggttctgacgtccgggtccccgttcccggggtcctaggacgtggttcgagtgggctaggtgatcgaggcaacgtagtattacacgtaggaataatcgagtacggaaggtagggagtacgtaggaaggtagttaggtttggttacgtttatacgtgcgtagtacgagttaaggttatcttaaccgtttactttacgtttacggtttcggaccggtaaggggtacccgagggtcgtagggaacgtaacgtaaaccggtaaacgtaacgtcggtacgtaccgtacg

SEQ ID NO: 329915 - DNA, 628 bp, Homo sapiens
  misc_feature: GZ8MTXP02ILIF9.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaactattggattggtatctgcagaagccgagggcagtctctcagctctgattcttagtttgggtctgacgttccggggccccgtcccggggtccctggactaggttcaggtggctaggtggatcgaggactacgagttatttacacgtagagtaattcgaggacgaaaggtgggaagtacgtagggaaggtagttgggtttaggtacgttttagttacgtgactagttacgtacgttaaaggtttacacttaactttaccgtttaaagtttaaccggttttcgggaaacccggtaacgggggtaccctagggtaccgttaggggtaaacgtaacgtaaacggtaaaacggtaacggttggtacgggtactaaccgg

SEQ ID NO: 329916 - DNA, 598 bp, Homo sapiens
  misc_feature: GZ8MTXP02JB8IZ.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagcccggcctccatctcctgcaggtctagtcagagcctcctgaatactaatggatacaactatttggattggtatctgcagaagccagggcagtctcctcagctcctgattcttagtttgggttctgacgtccggggccccgttcccggggtccctgacgtaggttcaggtggcaggtggatcagggcacagtatttacacgtagagaatcagacgaagtggagtacgaggaggtagtggtttaggtacgtttagttacctggtctaagtgtacgtaaggtttagtactacgttaccttaagtttacgtttacggggaccgtaacgggggtacccgtaaggggtcgtaggggtaacgtacgttaaacgaaaaccggtaacgttggtacggtaccgttacgg

SEQ ID NO: 329917 - DNA, 606 bp, Homo sapiens
  misc_feature: GZ8MTXP02G6VC1.45.86.H09.1.454.CMB.2.raw
  modified_base (258)..(258): a, c, t, g, unknown or other
  misc_feature (258)..(258): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatcctcctgcaggtctagtcagagcctctgaatactaatggatacaatnttgattggtatctgcagaagccagggcagtctctcagctcctgtattcgttagtttcgggtctcggtacgttccggggcccccgttaccggggtccctggacgtacggttccaggtgggactaggtgggactcgaggacacgtagttaactttacgacgtaggaagtaagtacgacggtaagaaggttaggaacgtagtaggagggttaattgggtttgtacgttttagtctaggctagtgtaacgttagtttacgtctactttacgttacgttcgtttacgggcggtaacgggtaccgtaagtcggtacggaagtacgtaaacgtaaacggtactggacgtcgtacg

SEQ ID NO: 329918 - DNA, 742 bp, Homo sapiens
  misc_feature: GZ8MTXP02GHXE0.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatcctcctgcaggtctagtcagacgccctcctagaatactaagtggaatactaactagttggattggtatcgtgacagaagccgagggcagtctcctcagtcctcctgtacttcgtttagtttcgggttctaggtacggttcccgggtccccccgtcccggggtcccctaggtaccgtacggtttcagggttcgggcaagggtcgggtactccggaaggtacctaaacgtaaagtttaactttttaaaccacgttaaggaacgtaaacgttaccgaagggtaaccgggtaaagggttaggggaaacgtacgggttaagggtaagggtaagggttttcgggttttaccggggttaacgtttttaaagttaacccgtggtactaaggtttacggaacggtttaaagggttttaccgtaccttaacccgtttacgtttaaacgttttccggtttaccgggaacccggttaacggggaccgtagggtccggtaaggaagttacgtaaacgtaaaacggcgttaggtcggacttaaccg

SEQ ID NO: 329919 - DNA, 577 bp, Homo sapiens
  misc_feature: GZ8MTXP02HBU6L.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaatattggattggatctgcagaagccgagggcagtctcctcagctctgacttctagtttgggtctgactcgggcccctccggggtcctgactggttcagtggcaggtgatcgaggcaaacagtactttacacgtagaacgtaatcgaggacgtaaaggtgggaaagtcgtaggaggtagttgggtttaggtacgttttaagtaccgtaggtactagttacggtacgtaaagggtttactacgtactttaccttagtttacgtttacggacgtacggggtaccaggtcgtaggaagtactaacgaacgtacgtaggtcggactacg

SEQ ID NO: 329920 - DNA, 642 bp, Homo sapiens
  misc_feature: GZ8MTXP02HSF3D.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtccacccgtggagacgccggcctccatcctcctgcaggtctagtcagacgccctctagaatactaagtgatactaacttattggattggtatctgacaagaagccgagggcagttcctcctcagctcctggtaacttcgttagtttcgggtctggacgtccggggtcccccgtaccggggtcccctgaccgtggttcaggttggctaggtcggactcgaggactaacgtagtaactttacgacgttagagtaactagacggagtaaggtggagtagtaggtaggtagtttcgggtttaggtaccgttttaagtaccgtagtacgtaaacttggtaaacgttaaagggttttacgtaccttaacgtttacttacgtttacggtttacggacgggtacggggtaaccgacgggtactagggaacgtaactaaaccgacggtaacgtggtacggtctacg

SEQ ID NO: 329921 - DNA, 592 bp, Homo sapiens
  misc_feature: GZ8MTXP02GEOXS.45.86.H09.1.454.CMB.2.raw
  modified_base (249)..(249): a, c, t, g, unknown or other
  misc_feature (249)..(249): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccgacctccatcctcctgcaggtctagtcagacgcctcctgaatactaangatacaatattgattgtatctgcagagccgagggcagtctctcagctcctgtactcttagtttcgggtctggtacgtccggggccccgttcccggggtcctaggaccgtaggttccagggtcggctaggtgacgtccgaggacacgtagttatttacgatagaagtaactcgagacgtaaggtggagtacgtaggaggtagttggtttaggtacgttttaagtactagcttaagtcgtaacgttaaggtttactacctactttacttagtttcggtttacggaccggtacgggaccgtggtacgtagggaactactaacgaaacggtagtggacgtacgtacg

SEQ ID NO: 329922 - DNA, 589 bp, Homo sapiens
  misc_feature: GZ8MTXP02GQ1XQ.45.86.H09.1.454.CMB.2.raw
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaactattggattggtatctgcagaagccagggcagtctctnagctctgatctatttgggtctgagtcgggctccccggggtcctgactaggttcaggtgcagtggatcgaggcanagtatttacatgagatcagacgaagtggagagtaggaggtattggttcggttagtttatacgttgacgtataggtacgtaaagggtttcgtactaccgttcttttaacgttaacggtttttcgggacccggttaaacgggggtacccgaaggggtccgttagggaaggtaacttaaaccggaaaaccggtaaacggttagggttacggccggttacgaaccccg

SEQ ID NO: 329923 - DNA, 571 bp, Homo sapiens
  misc_feature: GZ8MTXP02IGU7G.45.86.H09.1.454.CMB.2.raw
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
tcagacgcgatcgacacgaccggtgctcgatttagtgctatagacttgggtttgggggtggtcaggactcctcagttcaccttctcacaatgaggctccctgctcagctcctggggctgctaatgctctgggtctctggatcctttggggatattgtgatgactcagtctccactctccctgccccgtcacccctggagacgccggcctccatctcctgcaggtctagtcagagcctctgaatactaatgatacatattggattggtatctgacagaagccgagggcagtcctcctnagctcctgattcttagtttgggtctagngtccggggccccttcccggggtccctggtacgtgggtttcacgggtggactaggtcggatccgaggcaacgtagttattacatagataactnaggagaggtagagagaggtaggtattgggtttagtacgttttatagtgntagtagtacgttaaggtttacncttacttaccgtttagttaccgttttgaaccggtacggggaccaggtnaggtaanaacgtacaaaacggtgtggtcggactcg

SEQ ID NO: 329924 - DNA, 633 bp, Homo sapiens
  misc_feature: GZ8MTXP02JFVR3.45.86.H09.1.454.CMB.2.raw
  modified_base (271)..(271): a, c, t, g, unknown or other
  misc_feature (271)..(271): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagacgcctctgaatactaatgatacaactattggattggtatntgacagaacgccgagggcagtcctacctcacgtcctcctagatttacgttagtttggggttctggtacgtccgggtcccccgtcccggggtccctagaccgttggttccaggtcggacgtaggtcgggactcgacggtcaacgtaagttacttttacgacgtaggaacaacgtacgacgtaggaaggtaggaagtacgtagggaggttaggttgggtttcggtactttttacgtacgtgtacctaggttacgtacgttaaggtttactacgtactttacctttagttaccgtttacggacggtaacgggaccgtacggtcgtaaggaacgtaacttaacgaaacgtacgtggtacgtcgacg

SEQ ID NO: 329925 - DNA, 567 bp, Homo sapiens
  misc_feature: GZ8MTXP02HFU24.45.86.H09.1.454.CMB.2.raw
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctcctgaatactaatggatacaacttgttgattggtatctgcagaacgccgagggcacgtctcctcacgctctgattcttagtttcgggttctggacgttccgggccccgtccggggtcctgacgtggttcagtggctaggtggatcgagcanagtatttacatganatcgagacgaagtagagacgtaggaggtgtaggttagtacggtttatacgtgatagtgtacgtaagtttacgtacttacttacctttagttacctttcgggaccgacggggtacgacggtcgtaggaaacgtactaaacgaaaacgtaacgtcggtacgtacgtacg

SEQ ID NO: 329926 - DNA, 684 bp, Homo sapiens
  misc_feature: GZ8MTXP02IAYWQ.45.86.H09.1.454.CMB.2.raw
  modified_base (269)..(269): a, c, t, g, unknown or other
  misc_feature (269)..(269): n is a, c, g, or t
  modified_base (499)..(499): a, c, t, g, unknown or other
  misc_feature (499)..(499): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggattattgtgatgactcagtctccactcctccctcgcccgtccacccgtggacacgcccggcctccatcctcctgcgtaggtctagtcagacgcctctagaatactaagtgaatacaatnttggattggtatctgcaagaacgccgagggctacgtcctcctcgagtcctccgtagtactttacgtttagtttcgggttcttacggtaccggttcccggggtccccccggttccccgggggtaccctacggtacgtacggtttccgagggttcgacgtagtcggactacgacggactagtaacgtttactttaacgacgttaggaactaagtcgaaaggcggtaaagggnggacgtagtaggtagttgttgggtttacgttactttagtagtagtacgtagtacgtacgttaagttactacttaacgtttacgtttacggtttcggttaccggaaccgggtaacgggtaccgtgggttaacgtaggtaacgtaaacgtaaaccggtaaacggtacggttacggtaccgtacgacg

SEQ ID NO: 329927 - DNA, 608 bp, Homo sapiens
  misc_feature: GZ8MTXP02G2X0P.45.86.H09.1.454.CMB.2.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactcctccctgcccgtccacccctggagacgccggcctccatcctcctgcaggtctagtcagacgcctcctagaatactaatgatacaatattgattgtatntgcagacgcgaggcagtcctcncacgctctgattnttagtttggtctgtacgtccgggtccgtccccggggtcctgtacgtaggttcgacggtgcgtgtacggatcgaggcagtacgttaactttacgacgttagagtaacagaacgtaggtaaggtaggaaacgtagtagaggtagttaggttcggttagtttacttagtagactagtacgttacgttaaaggttctacttacgttactttacgttaccgtttcggaccgggtaacgggtaccgtagtaccgtaggtaacgtaacgtaaacggaaaacgtacgtaaggtcggtacgtcgtaacccg

SEQ ID NO: 329928 - DNA, 671 bp, Homo sapiens
  misc_feature: GZ8MTXP02G19EP.45.86.H09.1.454.CMB.2.raw
  modified_base (297)..(297): a, c, t, g, unknown or other
  misc_feature (297)..(297): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccgcctccatctcctgcaggtctagtcagagcctcctgaatactaatggaatacaactatttggattggtatctgcagaagccgagggcagtctcctnagctcctgattctagtttgggtctgacgtcgggcccctccggggtccctggacgtaggtcaggtcggcaggtggatcgaggctaacagtatttacacgtgaacgtaatacgaggacgtaaagggtggaacgtacgttaggaagggtattaggtttagggtaccgtttttaagtacgttacggacctagttaggaccgttaaaggggttttaacgtaccgtaaaccgtttaccctttaaaagttttaaacccggtttttcggggaaacccccgttagggggggaaaccccctacgggggttaccgttaaacggggaaaggtaaacttaaacccggaaaaacggtaacccgtttgggacggggtttactaacccgg

SEQ ID NO: 329929 - DNA, 643 bp, Homo sapiens
  misc_feature: GZ8MTXP02JY4OC.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtcctccactcctccctgcccgtcacccctggagacgcccggcctccatcctcctgcaggtctagtcagacgcctcctagaaactactaagtggaataactaacttagtttggattggtatctgacagaacgccgagggctacgtcctccgtcagtctccgtgattcgttagtttggtctggacgtccggtcccccgtccggggtcctaggtacgtacggttcagggtcggacgtaggtaggatcgaggcaaacgtagttacgtttaacacgtaagaagtaaacgtacgaacggtacggtaaaggtaggaggtaccgtagggtaggtaggttgggtttacggttacgttttaagtacgtgtacgtagttacgtacgttaaaggttctactaactttacgttacttacggttacggacggtacggtaccgaggtacgtaggaacgtacgtaacgtaaacgtagtacggtacgcgtaccg

SEQ ID NO: 329930 - DNA, 656 bp, Homo sapiens
  misc_feature: GZ8MTXP02FSH9J.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagcccggcctccatcctcctgcaggtctagtcagacgcctctgaatactaatggaatacaacttatttggattggtatctgacaagaacgccgagggcagtcctcctcagcctcctagtattcgttagttttggggttctggtacgtccggggtcccccgttcccggggtccctaggtacgtaggttccagggttggcgtaggttgactcgaaggccaacgtaagttatttaaccacgttagaagtaatacgagtacggtaagtgggaagacgtagggaaggtagttagggttcggttacgttttaagtacgtggtactagtagtacgtttaaaggtttacgtacttaactttacccgtttaagtttaccgttttacgggacccggtaaagggggtaccctagggtaccgttacgggaagtaacgtaacggtaaaacgtacgttggtacggtcgtaacg

SEQ ID NO: 329931 - DNA, 575 bp, Homo sapiens
  misc_feature: GZ8MTXP02JROND.45.86.H09.1.454.CMB.2.raw
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (384)..(384): a, c, t, g, unknown or other
  misc_feature (384)..(384): n is a, c, g, or t
  modified_base (448)..(448): a, c, t, g, unknown or other
  misc_feature (448)..(448): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagacgccggcctccatctcctgcaggtctagtcagagcctcctgaatactaatggaatacaattattggattggatctgcagaanccgaggcagtctcnagctcngatctagtttggtctgagtcgggcccctccggggtcctgactaggttcagtggcagtggatcaggcacagtactttacactganagtacaggacgaaagtggacgtagtaggaggttactgggtttaggacgttttatacgttcgganagttcggaagttaacgggttttacacctacgttacctttaacgtttccgtttacggaccggttacggggaacccgtaggtaccggttaggaaggtaactaccgaaaaggaccttggacggtctaccg

SEQ ID NO: 329932 - DNA, 657 bp, Homo sapiens
  misc_feature: GZ8MTXP02GCW1R.45.86.H09.1.454.CMB.2.raw
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
tcagacgcgatcgacacgaccggtgctcgatttagtgctatagacttgggtttgggggtcaggactcctcagttcaccttctcacaatgaggctccctgctcagctcctggggctgctaatgctctgggtctctggatccttgggatattgtgatgactcagtctccactcctccctcgcccgtccaccccgtggagacgcccggcctccatcctcctgcaggtctagtcagacgcctcctagaattaactaagtggaataactaacttagttggattggtatctagacgaagaacgccgaagggctacgttcctaccctcacgtcccttaccgtgtactttcgtttagttttcgggttctggtaccggtccggggtcccggtcccccggggtccctagtaccgtaggttcgaggttcggcgtagggtggacgtacgacggactaaacggtactttactttaanacgtagaaagtactcgaaggacggtaaggnggaacgtagtggtaagtattccgggtttagttacgtttaagtctagagtagttacgtacgttaaggttcctactacgttctttaagtttcggttcgggacgtaccggggactcggtacgtaggaacaacgttaaccgaaagtcgtaggtcgacgtcgtaaccc

SEQ ID NO: 329933 - DNA, 630 bp, Homo sapiens
  misc_feature: GZ8MTXP02I7Y68.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtcacccctggagacgcccggcctccatcctcctgcaggtcctagtcagagtcctctagaatactaatgatacaattgttgattgtatctgcagagccgaggctagtcctccgcacgtccttctagtatttcgttagttttcgggtctcggccggtccgggtcccgttccccggggtccctagacgttacggtcgaggttcgcgtaggtcggtaactcgacggactacgtaagttactttacgacgttagaacgtatacgagaacgtaggacggagtacgaggtagttagttggttacgtttagtttactagtctagtagttagtagtttaaacggttcttacttaacgttacgtttacgtttacggtttacggaaccggggttaacggacggtacggtacgtaaggtaccgtaagtacgtaaaacgtggtcgtacggctactaaccg

SEQ ID NO: 329934 - DNA, 702 bp, Homo sapiens
  misc_feature: GZ8MTXP02H2DU1.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactcctccctgcccgtcacccctggagacgccggcctccatctcctgcaggtctagtcagagcctctgaatactaatgatacaactattggattggtatctgcaggaagccgagggctagtcctcctcagtcctctgattcttagtttggttctgacgtccgggtccgttccccggggtccctagtacgtcggttacacggttggcgtaggtagggacttccgggaaggtccaaacgttaaacggttacgttttaaacgacgtttagaaacgtaaagtaccgtaggtaacggtaaagggttaggaaacggtagtgggtaaagggttacgtttgggtttacgggttacgtttttaagttaacgttggtacgttaaggtaacggttaacggtaaaggttttacgtaccgttaaccgtttaccttttaacgtttaaccgttttacgggtaccggaaacggggtacccgtagggtacggttaggaaacgtaacgtaaacgaaaacggtaacgttggtacgtacggttaacgtacccg

SEQ ID NO: 329935 - DNA, 602 bp, Homo sapiens
  misc_feature: GZ8MTXP02H1KDZ.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatccgtttggggatattgtgatgactcagtctccactcctccctgccccgtcaccctggagacgccggcctccatcctcctgcaggtctagtcagacgccctctagaatactaagtggaatacaaacttagtttggattggtatcgtgacaaggaacgccgaagggcacgtcctcctacgacgtcctccgtgtacttcgttagtttcgggtctggtacgtcccggggtccgtccccggggtccctgacgtaggttcgaggtggctaggtagactcgagtcatagttattacatagagtagtcagacgaaggtacgagacgtagaggtagttggttaggttacgtttaattacgtgtatagtagtacgtaagttacgtactacttactttacgttacgtttcgggaccgtacgggaccgagtacgtaggacgtaacgtaacgaaacgtcgtacgtcgtacgtcaccg

SEQ ID NO: 329936 - DNA, 620 bp, Homo sapiens
  misc_feature: GZ8MTXP02HW33X.45.86.H09.1.454.CMB.2.raw
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccctggagacgccgcctccatctcctgcaggtctagtcagagcctctagaatactaatgatacaatattgatgtatctgcagagcgaggcagtcncnacgctctgtactnttagtttgggtctgacgtccgggccccgttccggggtccctggacgtggttcgagtggactaggtggactacgaggactaacgtagttaactttaacacgtagaagtaaatcgaaggtacgaaggtggaagtacgtaggaggtagttgggtttaggttacgttttaactacgtagcgtaagttacggtaacgttaagggtttaactaccttaacctttacctttaagtttacggtttacggaccgggtaaacgggtaccgacgggtaccttaaggggaactaacgtaaacggtaaaaccgtgtacggtacggtactaaccgg

SEQ ID NO: 329937 - DNA, 657 bp, Homo sapiens
  misc_feature: GZ8MTXP02GBZYN.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttgggatattgtgatgactcagtctccactctccctgccccgtcaccccgtggagacgcccggcctccatcctcctgctaggtctagtcagacgccctcctagaatactaatggaactacgaacttagttggattggtatctagcaagacgcgagggctagtctcctcacgtctctagtactcttagtttcggtctgtacgtccggggtccccgtcccggggtcctagacgtcggttcgaagggttggcgaggtcgatcgaggacagtaagttactttacgactagaaatagtacgaaggtacgtaaggtgaaacgtaggtaggtaaggtagttggttacggttaactttacgtaacgtgactagtacgtaagttaggttacgtaccttacgttaccgtttaacgtttaccggtttacggaacggtaccggggtaaccgtaccgggtagttaacgggaaacgtaacgtaaaaccggtaaacccggttacggtttaggccgggtacttaacccgg

SEQ ID NO: 329938 - DNA, 627 bp, Homo sapiens
  misc_feature: GZ8MTXP02JC7HE.45.86.H09.1.454.CMB.2.raw
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (405)..(405): a, c, t, g, unknown or other
  misc_feature (405)..(405): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgccccgtcacccctggagacgcccggcctccatctcctgcaggtctagtcagagccctctagaatactaatggaatactaacttattggattggtatctgcagaagccgagggcagtctcctnacgctccngtacttcttagttttgggtactgacgtcccgggccctcccggggtcctgacgtaggttcagggtggtcgaggtgactcgaggactactaagttnttttaaccgacgtaggagtaaatacgaacgggtagtaaagggtggaaacggtacggttagggtaacggttaggtttacgggtttaggttacgtttaacgttacgtgtaacgtagttaggtacgttaaggtttactacgttaccgttacgttacgttacggttacgggacggtacgggtacgaggtcgtagaacgtacgtaacgaaacgtgtgtacgcgtacg

SEQ ID NO: 329939 - DNA, 652 bp, Homo sapiens
  misc_feature: GZ8MTXP02I8EEG.45.86.H09.1.454.CMB.2.raw
  modified_base (291)..(291): a, c, t, g, unknown or other
  misc_feature (291)..(291): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcaccccgtggagacgcccggcctccatctcctgcaggtctagtcagacgcctctgaatactatgatacatattgattgtatctgcagacgccgaggcagtctccnagctctgtattcgtttagtttcggtctagtacggtccgggtccccccgttcccggggtccctggtaaccgtagggttccgagggttcgggacgtaggtcgggatccgaagggtacctaacgtaacgttaacttttaccgaacgtaggtaagtaaacgtacggaagtacgggtaagggtaggaacggtacgtaagggtaaggttaggttggtttagggttaacgttttagtaccgtagaacttagttagtacgttaaggtttacgtacttaccgtttacttacgtttacggtttcggaccgtacgggtacgagggttacgaaggtaacaacgtaaacgtaaccgtggtacgtcgtcgtaccg

SEQ ID NO: 329940 - DNA, 619 bp, Homo sapiens
  misc_feature: GZ8MTXP02HN0RN.45.86.H09.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtctccactctccctgcccgtcacccctggagagccgacctccatctcctgcaggtctagtcagagccctcctgaatactaatggatacaactattgattggtatctgcagagccgagggcngtctcctcagctcctgatcttagtttgggtctgtacgtccggggcccccgtcccggggtcctggacgtaggttcaggtggactaggtggactcgagggccaacgtagttaacttttaccacgtaggaacgtaaatacgagacgtaaaggtggaaagacgtagggaaggttagttggttttggtacggttttaacttacgtgtacgtagtggtaacgttaagggtttactacttaaccgtttactttaacgtttccggtttacggaccggtacggggaccgtacgggtcgtaggtaacgaacgtaacgaaaacggtacgtggtacggctacgg

SEQ ID NO: 329941 - DNA, 688 bp, Homo sapiens
  misc_feature: GZ8MTXP02FIENS.45.86.H09.1.454.CMB.2.raw
  modified_base (169)..(169): a, c, t, g, unknown or other
  misc_feature (169)..(169): n is a, c, g, or t
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (343)..(343): a, c, t, g, unknown or other
  misc_feature (343)..(343): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggatattgtgatgactcagtcnccactctccctgcccgtcaccctgganacgccggcctcatcctcctgacaggtctagtcagacgccctcctagaattacctanggaatacaacttagtttggattggtatctgcagaacgtccgagggctagtcctaccctcacgctcctagactcgtttagtttcgggttacnggtaccgtccggggccccctcccgggggttccccaggtaccgtagggttccagggttcgaccgaggttggactcgaggccaagactaattttacacgtagacaataccaggaacgtaggtggaagacgttggaaagtgttggtttaaggttccgttttaaactacgttcggaccttagtacgggtaaccgttaagggtttaaccgtacttaaccccgttacctttaacgtttaaccggttttcgggaaacccggttacggggaaccccggttaacggtcccgtaaggggtaaccaaccgtaaaccgtaaaaaccccggtaggtttacggtacggtacccgtaccg

SEQ ID NO: 329942 - DNA, 741 bp, Homo sapiens
  misc_feature: GZ8MTXP02GL9AL.45.86.H09.1.454.CMB.2.raw
tcagacgcgatcgacacgaccggtgctcgatttagtgctatagacttgggtttgggggtcaggactcctcagttcaccttctcacaatgaggctccctgctcagctcctggggctgctaatgctctgggtctctggatcctttggggatattgtgatgactcagtctccactctccctgcccgtccacccctggacgacgccggcctccatcctcctgcaggtctagtcagacgcctctagaacttactaatggaatactaacttatttggattggtatcgtagactaagaacgccgagggcctaacgtcctaccgtacacgtcctcgtgtaacttcgtttaaggttttcgggttacctaggtaccggtccggggtcccgttacccccgggggttaccccctaggtaaccgtacggggtttcgtacgggttcgggaccgtaggtacggtaacgtacgagggactaaacgttagttaaacctttacgaacgttagaacgtaaactacgaagacggtaaggtagggaacgtagtaggtaagggttagtttcggttaacgggtttctttaacgttaagttcgccgtaagttacggtaacggtttaaacggtttactaccgttaacttttaccggtttaacgtttaccgggttttacggaacccgggtaacgggggtacgtacgggtagtacggtaacgttaacgaacggtaaaacgtacgttcggtaacggcttacgtaacccg

SEQ ID NO: 329943 - DNA, 730 bp, Homo sapiens
  misc_feature: GZ8MTXP02HUAP4.45.86.H09.1.454.CMB.2.raw
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggattattgtgatgactcagtctccactctccctgcccgtcacccgtggacgacgccggcctccatctcctgcaggtctagtcagacgtccctctagaatactaagtggaactactaacttagttggtattggtatcgtgacgaagaacgccgaagggcctaggttcctcctacgacgtccttaccgtagtactttacgttagttttcggggtactggtaccggtccggggtcccccgtccggggtccctaggacgttagggttccagggtcggtcgtaaggttcggaacttaccggaggacctaacgtagttaaactttaccaggtagaacgttaaacgtcgaaaccggggtataaacgggggtggaaaccgtagggtaggttaaggtaccgtttagggttttaccgggtagtttaatccgtaggattacgtagggtacgtttaaaaggttctaaccttacttttaaccgtacggtttttaccggttacgggaaaccggttaacgggggaccctacggggtataacggggaaacttacgtaaaccggtaaaacggtgtttacggacggttctaaccccggg

SEQ ID NO: 329944 - DNA, 626 bp, Homo sapiens
  misc_feature: GZ8MTXP02H4CED.45.86.H09.1.454.CMB.2.raw
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatccgtttggggatattgtgatgactcagtctccactctccctgcccgtcacccctggagacgccggcctccatctcctgcaggtctagtcagacgcctctagaatactaatgatacatnttgatgtatcngcagaagccagggcagtctcacagctctgattctagtttggtctggacgtccgggcccctccggggtcccaggactaggttcaggtcggctaggtcggactacgacgggaccaactagttactttacgacgttagaagtaatacgaggtacggtaagtacgggagtacgtagggtaggttagttgggtttagggttacttttaagttaccgtagtacgtaagttcgtaaccgttaaggggtttaactccgttaaccttaccgtttaagtttaccggttttacgggaaccggttacggggacgtacgggtcgtacggggtaaatacgtaaacgtaacggacgtaggtcgtaccgtacg

SEQ ID NO: 329945 - DNA, 649 bp, Homo sapiens
  misc_feature: GZ8MTXP02JCAJ7.45.86.H09.1.454.CMB.2.raw
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagacgcgatcgacacgaccggtgctcgatttagtgctatagacttgggtttggggtggtcaggactcctcagttcaccttctcacaatgaggctccctgctcagctcctggggctgctaatgctctgggtctctggatcctttggggattattgtgatgactcagtctccactcctccctcgcccgtccaccccgtggacgacgccccggcctccactcctcctgcaggtctagtcagacgcctctagaatactaatgatacaattattggattgtatctgacagacnccgaggcagtcctctcncgtctcntattcgttagtttggtctggcggtccggtccccggtccgtcgagtacgtgtacgtgtgcgtaggtgtacgtcgaacgcagttacgtttataccgtagtagaacgttacacggacggtaaggaaggacggtaagtcggaaggggtacgttgggttacggtttagtactttagtacgtcgtacgttaggtacgttaaacgtaggttaccttactaccgttttacttaacggtttacgttaccccggggaagggtacccggtaggtacggttaacgtaacggaaccgttaaaacgtaaaacccggacggttaggtcgggtaaacccgttcggaacccc

SEQ ID NO: 329946 - DNA, 634 bp, Homo sapiens
  misc_feature: GZ8MTXP02FVNMV.45.86.H09.1.454.CMB.2.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (448)..(448): a, c, t, g, unknown or other
  misc_feature (448)..(448): n is a, c, g, or t
  modified_base (587)..(587): a, c, t, g, unknown or other
  misc_feature (587)..(587): n is a, c, g, or t
tcagacgcgatcgacacgaccggtgctcgatttagtgctatagacttggggtttgggggtcaggactcctcagttcaccttctcacaatgaggctccctgctcagctcctggggctgctaatgctctgggtctctggattccgtttggggattattgtgatgactcagtcctccactcctcccgtcgccccgtcaccccgtggacgacgcccggcctccatctccngcaggtctagcagcncctcagaatactatgatactaatgttgatcgtanctnanagacgcgaggcagtcnctcngtcctacgtgtatcgtttagttggttctcggaccggtccgggtccggtcccccgggtacctgtacggttacggtcgnggttacgcgtaggtgactcgacggtacacgtagtttacttaacgcgtaaaggatacctggagagggtaagngtaagagtcggaaggttgttcgggtttcggttagtttacgttacagtagtacgttaggttaacgtttagtttccgtaaccgtttccctttaatttacggttacgtttaccggggaaccggacgggttacgcgttacggngaaaacggtaactaacgaaaaccggttgtcggacgtcggattaaccc

SEQ ID NO: 329947 - DNA, 553 bp, Homo sapiens
  misc_feature: GZ8MTXP01BJVU6.21.26.C04.1.454.CMB.2.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (478)..(478): a, c, t, g, unknown or other
  misc_feature (478)..(478): n is a, c, g, or t
tcagtcgtcgctcgcacgaccggtgctcgatttagtctagcgactttgggtttgggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccacctctcctgcagggccagtcagattgtggcaacaactacttagcctggtaccagcagaacctggccaggctccaggctcctcatccatactgcctccaagnggccactggcatccctgacaggttcagtggccaggtggtctgggacaagacttcactctcaccatcaccagactggagctgatgtattttgctagtttattactgacctaccaactattcgtctttccgcacccgtctacgtacggttcgggcgggtacgggacccgnggggtaagggaagagtaccgaaaacggtaactggttcgggcttggccaccaagtctgttaccttcgaacttcccg

SEQ ID NO: 329948 - DNA, 525 bp, Homo sapiens
  misc_feature: GZ8MTXP01C6JCA.21.26.C04.1.454.CMB.2.raw
  modified_base (205)..(205): a, c, t, g, unknown or other
  misc_feature (205)..(205): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctcaggggaaangccacctctcctgcagggccagtcagattgtggcaacaactacttagcctggtaccagcagaactggccaggctccaggctcctcatccatactgcctccaagagggccactggcatccctgacaggttcagtggccaggtgggtctggggacaagacttcactctcaccatcacagactggagcctgatgattttgctagtttattactgtacccaccaacatcgtcctttcgcctaccgctcgtaccgttcggcggagggaccgaggggtggagatacgaaacgaactgttggcttgcaccntctgttcttcnttccg

SEQ ID NO: 329949 - DNA, 547 bp, Homo sapiens
  misc_feature: GZ8MTXP01CVL5T.21.26.C04.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccacggagaaattgtgttgacgcagtctccggacaccctgtctttgtctcaggggaaangccacctcncctgcaggccagtcagattgtggcaacaactacttagcctggtaccagcagaaactggccaggctccaggctctcatccatactgcctcaagcggccatggcatcccngacaggttcaggtggccaggtggtctgggacaagacttnactctcacntcaccagactgganctgatgtattttgctagtttatactcgacctaacaactattacgtctttcgacctaacccgtctccgtaccggttcgggcgggacgggtaccgaggggtcggaagagtacgaaaacgtacgtaggttcgcttcgctaccgaatctgttacttcgaactttcccg

SEQ ID NO: 329950 - DNA, 632 bp, Homo sapiens
  misc_feature: GZ8MTXP01BBKAA.21.26.C04.1.454.CMB.2.raw
  modified_base (207)..(207): a, c, t, g, unknown or other
  misc_feature (207)..(207): n is a, c, g, or t
  modified_base (316)..(316): a, c, t, g, unknown or other
  misc_feature (316)..(316): n is a, c, g, or t
  modified_base (361)..(361): a, c, t, g, unknown or other
  misc_feature (361)..(361): n is a, c, g, or t
tcagtcgtcgctcgcacgaccggtgctcgatttagtctagcgactttgggtttgggagagaagagctgctcagttaggacccagagggaaccgatggaacccacgcgcagcttctcttcctcctgctactctggctcccagataccaccggagaaattgtgttgacgcagtctccggacaccctgtctttgtctccaggggaaaganccaccctctcctgcagggccagtcagattgttggcaacaactacttagcctggtaccagcagaaacctggccaggctcccaggctcctcatccatactgccctccaagngggccactgggcatcccctgacaggttcagtggccaggtgggtcnggggacaagacttcactctcacccatccacagctggagacctgatgtacttttgactagtttactactcgtaccaacctaacacttcggtcctttaccgcctaacccgtcttaccgtaccgggtttcggggtccggggaacggggtaacccgtagggggtaagggaaacgttaacgttacccgaaaacgggtaaccgttgggttacgggttccgttcggaacccgtaacccgtaacttccgttcgttaccgtttccgttaacgtttccccg

SEQ ID NO: 329951 - DNA, 530 bp, Homo sapiens
  misc_feature: GZ8MTXP01BT52N.21.26.C04.1.454.CMB.2.raw
  modified_base (206)..(206): a, c, t, g, unknown or other
  misc_feature (206)..(206): n is a, c, g, or t
  modified_base (525)..(525): a, c, t, g, unknown or other
  misc_feature (525)..(525): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtgcaacactacttagcctggtaccagcagaacctggccaggctccaggctctcatccatactgcctccaagacgggccactggcatccctgacaggttcagtggccaggtggtctgggacaagacttcactctcaccatcaccagactggacgctgatgtattttgctagtttatactgacctaaccaactactgtcctttcgcctaccgctcgacgttcggcgggtacgggaccgaggggtcggagatacgaaacgtacgtggttcgcttgcacaatctgttcttcnttccc

SEQ ID NO: 329952 - DNA, 544 bp, Homo sapiens
  misc_feature: GZ8MTXP01EHLO8.21.26.C04.1.454.CMB.2.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (389)..(389): a, c, t, g, unknown or other
  misc_feature (389)..(389): n is a, c, g, or t
tcagtcgtcgctcgcacgaccggtgctcgatttagtctagcgactttgggtttggggagagaagagctgctcagttaggacccagagggaaccatggaaaccccagcccagcttctcttcctcctgctactctggctcccagataccaccggagaaattgtgttgacgcagtctccggacaccctgtctttgtctccaggggaaangccaccctctcctgcagggccagtcagattgtgcaacactacttagcctggtaccagcagaaacctggccaggctcccaggctccncatccatactgcctcaagnggccactggcatccctgacaggttcagtggcagtgggtctgggacagaacttcaactctacaccatccacagactgancctgatgtattttgacttagtttatactgaccaactaacatcgtactttcgctaccgctccgtacggttcgggcggtagggaccgtaggggtggaaggacttacgaaacgacgtggtacggcgttgccaacatctgtcttctaacgttcctcccg

SEQ ID NO: 329953 - DNA, 583 bp, Homo sapiens
  misc_feature: GZ8MTXP01CMTHO.21.26.C04.1.454.CMB.2.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
  modified_base (398)..(398): a, c, t, g, unknown or other
  misc_feature (398)..(398): n is a, c, g, or t
  modified_base (498)..(498): a, c, t, g, unknown or other
  misc_feature (498)..(498): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgtctccgaggggaaangccaccctctcctgcagggccagtcagattgtggcaaacaactacttagcctggtaccagcagaaacctggccaggctccaggctcctcatccatactgcctcaagcggccactggcatcccngacaggttcagtggcctaggttggtcgtggggacaagtacttcactctacacatcaaccagactggacncctagattgtatttttgacttagtttattactcgacctaacaactagttcgtcctttaccgcctacccgtctacgtaccggttcggcgggacgggaccgngggggtaagaagactacgaaacggtaactggttacggcttcggaaccacccgtaatccgttgttaccttcgttaacgtttccccg

SEQ ID NO: 329954 - DNA, 562 bp, Homo sapiens
  misc_feature: GZ8MTXP01BZSVG.21.26.C04.1.454.CMB.2.raw
  modified_base (206)..(206): a, c, t, g, unknown or other
  misc_feature (206)..(206): n is a, c, g, or t
  modified_base (404)..(404): a, c, t, g, unknown or other
  misc_feature (404)..(404): n is a, c, g, or t
  modified_base (554)..(554): a, c, t, g, unknown or other
  misc_feature (554)..(554): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacactacttagcctggtaccagcagaaacctggccaggctcccaggcctcctcatccatactgccctaccaaggcgggcccacgtgggccatcccctagaccagggttcaggtggcctaggttggctggggacagacttcactctcaccatcacagactganctgatgtatttgctagtttatactcgaccaaccaatcttgtccttcgcctaccgctcgacggttccggacgggacgggaccgaggggtcggagttactaccgaaacgtacgtggttacgggcttacggccactaattcgtgttccttcgntttccccg

SEQ ID NO: 329955 - DNA, 547 bp, Homo sapiens
  misc_feature: GZ8MTXP01DONOA.21.26.C04.1.454.CMB.2.raw
  modified_base (205)..(205): a, c, t, g, unknown or other
  misc_feature (205)..(205): n is a, c, g, or t
  modified_base (331)..(331): a, c, t, g, unknown or other
  misc_feature (331)..(331): n is a, c, g, or t
  modified_base (373)..(373): a, c, t, g, unknown or other
  misc_feature (373)..(373): n is a, c, g, or t
  modified_base (472)..(472): a, c, t, g, unknown or other
  misc_feature (472)..(472): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctcaggggaaangccacctctcctgcagggccagtcagattgttggcaaacaactacttagcctggtaccagcagaaacctggccaggctcccaggctcctcatccatactgcctccaaggcgggccatggcatcccngacaggttcagtgccaggtggtctgggacaagacttcactcncaccatcacagactggagcctgattgtattttgcttagtttatactcgacctaaccaactatgtctttcgctaccgctcgacgttcggcggaggaccgngggtaaggagagtacgaaacgtaacgtggttacggcttacggctactaattcgtcgttcttcgttaactttcccg

SEQ ID NO: 329956 - DNA, 754 bp, Homo sapiens
  misc_feature: GZ8MTXP01DGFL3.21.26.C04.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtctagcgactttgggtttggggagagaagagctgctcagttaggacccagagggaaccatggaaacccagcgcagcttctcttcctcctgctactctggctccagataccacggagaattgtgttgacgcagtctccggacaccctgtctttgtctccgaggggaaancgccacctctcctgcagggccagtcagtattgtggacaaacaactacttagcctggtaccagcagaactggccaggctccagctcctcatccatactcgccctacgaaggcgggccacgtggaccacttccccgtagactacgggttcaggtcggaccctagggttggggtcgtagggggaactaacgggtaccctttcgaacctttcacccaaccctactaccaaacccgtaagacccgttagggaaccgtcccgttaggtaacgtttcggttaagtttttcgtaaccgtttaagtttttaaacttaccgttaccggacccttaaaccccgtaaagttaaccgtttacggttcccctttttaccggaaccctaaccccgttcccgttaccggtaacccggggttttcccggggaccggggtaaaccgggggacccggtaaggggggttaacggaaacgaacgttaaaccgaaaaccggttaaacgttcgggacggttccttacggaaccctaacgtcttcgttcgtttcccttaacgttaaccttccccg

SEQ ID NO: 329957 - DNA, 753 bp, Homo sapiens
  misc_feature: GZ8MTXP01ERIAG.21.26.C04.1.454.CMB.2.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaanagccaccctctcctgcagggccagtcagattgtgcaanactatagcctggtaccagcagaacctggccaggctccaggcctcctcactccatactcgaccctacccgaaaggacgggggaccccaacgttcgggacctaaccgttcccccgtaggtaaccgtaacgggtttccgaaagggttcgggccccgtaaggggtttcggggtaccgtacgggggaaacctaacgggtaaccctttcgtaaaccttccgtacccaacccgtaactcccaaaccgtaacgtacggttacgggaacggtcccttagggtaacttgggttaaactttttcgggacttaacggttttaattaccgtacgtaacccctaacctaaacgggtacttcggtaccttccgcctaaccgtcctacggtaccggttcggggaccggtaacgggtaccgaagggggttaacgaacggttacgtaaacggaaaacgggtcgttggttaccgggcttacggaaccctaccgtaactcgtcggttccttaacgttaactttccccg

SEQ ID NO: 329958 - DNA, 564 bp, Homo sapiens
  misc_feature: GZ8MTXP01A7WML.21.26.C04.1.454.CMB.2.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (482)..(482): a, c, t, g, unknown or other
  misc_feature (482)..(482): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaangccacctctcctgcagggccagtcagattgtggcaaacaactacttagcctggtaccagcagaaacctggccaggctcccaggctcctcatccatactgccctccaagacgggccactggcatcccctgacaggttcagtggccaggtgggtcnggggacaagacttnactcncacntcacngactggagcctgatgtattttgctagtttatactgacctaccaatatgtcctttcgcctaccgcttaccgacggtttcggcgggaacgggaccgngggggtcgagacgtaccgaaaaccgtaagtggcggcttcggaaccaccgtaattccctggttccttccgttaagttcccccg

SEQ ID NO: 329959 - DNA, 548 bp, Homo sapiens
  misc_feature: GZ8MTXP01EA2ZA.21.26.C04.1.454.CMB.2.raw
  modified_base (205)..(205): a, c, t, g, unknown or other
  misc_feature (205)..(205): n is a, c, g, or t
  modified_base (403)..(403): a, c, t, g, unknown or other
  misc_feature (403)..(403): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacacctgtctttgtctccgaggggaaangccacctctcctgcagggccagtcagtattgttggacaaactaactacttagcctaggtaccagcaagaaacctggccaggctccaggctcctcatccatactgcctacaaggcggccagtcggcactccctgacaggttcaggtcgccaggtgggtctggggacagtacttcactctacactatcaacagactgacnctgatgtattttgacttagttattactgacctacaacgtatcgtacctttcgacaccgctacgtacgttcgggcggacgggtccgaggggtcgaagactacgaaacgactggttggcttgcacgaatcgtnttcttcncttcccg

SEQ ID NO: 329960 - DNA, 550 bp, Homo sapiens
  misc_feature: GZ8MTXP01BMKB3.21.26.C04.1.454.CMB.2.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaangccaccctctcctgcagggccagttagattgtgacaacactacttagcctggtaccagcagaacctggcaggcnccagctctcatcatctgcctcaagcggccacgtggcactccctgacnggttcagtggcaggtgggtcngggacagacttcnctctcaccatccaccagactggacnccgtagatgttatttggcttagtttacttacncgtaccactaactgtcgtcttccgctaccgtctaccgtacggtcgggcggtacgggaccgtaggggtgaagtacttacgaaacgttacgtggtcgcgttgcaacctatcgtcgtcttactcttccgtcccg

SEQ ID NO: 329961 - DNA, 584 bp, Homo sapiens
  misc_feature: GZ8MTXP01D7A0U.21.26.C04.1.454.CMB.2.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctctggacaccctgtctttgtctccgaggggaaanacgccaccctctcctgcagggccagtcagattgtgcaacaactactagcctggtaccagcagaacctggcagctccagctctcatccatacngcctcaaggcggccatggcatcctgacnggttcagtcggcaggtggtctgggaacagtctcacctctacacctatccaacagacgtggacgtccgtagacgttagtatttttcggactttaagtttacttaccgtcgaacccctaaccgtaaactacgttcgtacctttaccgcctacccgtctaccgtaccggttcgggacggtacgggaccgaaggggtcgagtacgttacgtaaaacggtacttgggttcgctgcctaactacttcttgttccttcgtaacc

SEQ ID NO: 329962 - DNA, 640 bp, Homo sapiens
  misc_feature: GZ8MTXP01AUOKL.21.26.C04.1.454.CMB.2.raw
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangcccaccctctcctgcagggccagtcagattgttggacaacaactacttagcctggtaccagcagaacctggccaggctccaggctctcatccatctgcctcaagcggccagtcggcactccctgacnggttcagtgccaggtgggtctgggacaagtacttcactctacaccatcaccagactggacgtctgactgtactttgacttagtttactacgtcgaccctaaccaaacgtgttacggtccctttacgaccctaaccccgtccgttaaccgtaccgggtttccgggggaccggggtaaccggggtaaccgtggggggttaacggaacgttaacgtacccgaaaacgggtaaccgtgggttcggggccttacggaaccctaccccgtaattcccgttaaccggttccttaaccgttaacttttcccccg

SEQ ID NO: 329963 - DNA, 519 bp, Homo sapiens
  misc_feature: GZ8MTXP01AB2JC.21.26.C04.1.454.CMB.2.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (453)..(453): a, c, t, g, unknown or other
  misc_feature (453)..(453): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccacctctcctgcagggccagtcagattgtgcaacactacttagcctggtaccagcagaacctggccaggctccaggctcnatccatacngcctccaagagggccatggcatccctgacaggttcagtggccagtggtctgggacagacttcactctcaccatcaccagactgagctgatgatttgctagttatactgccacaacgtntcgtcttcgctcgtctcgtacggtcggcggacggacgngggtgagacgtaacgaaacgtacgtggttcgcttcgaacactcgtctcgttcttcgttcgttcccg

SEQ ID NO: 329964 - DNA, 536 bp, Homo sapiens
  misc_feature: GZ8MTXP01E0K1Q.21.26.C04.1.454.CMB.2.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccacctctcctgcagggccagtcagattgtgcaacaactacttagcctggtaccagcagaaacctggccaggctcccaggctcctcatccatactgcctccaagngggccactggcactccctgacnggttcagtggccaggtgggtctggggacaagcttcactctcaccatcaccagactggagcctgatgtactttgctagtttatactgacctaccaacatgctttcgcctacccgctccgtacgttcgggcggtacggggacacggggtgagactacgaaacgactaggcggcttggcacctaatctgttcttcaacgttccc

SEQ ID NO: 329965 - DNA, 638 bp, Homo sapiens
  misc_feature: GZ8MTXP01A2IIF.21.26.C04.1.454.CMB.2.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccgaggggaaangccaccctctcctgcagggccagtcagtattgtggacaaacaactacttagcctggtaccagcaagaacctggccaggcctccgagcctccncactccatactcgccctacaaggcggccacgtggctactccctagacctagtcaggtcgccaggtcggntggacaacgtacttcactctcaccgtatccaacgngtacctggactcgtagtattagttactttagacttagttttactacgtcgtaccaacctaagtacgtcgttccttcgacctacccgtcgtaccgtacgggttccgggacgggtaacgggtaccggtaggggtaacggtaacgttacgtaaaccgaaacggtaaccgtgggttaacggttcgttacggaacctaccgttaacgttccttggttacccttaacgttaaccctttcccg

SEQ ID NO: 329966 - DNA, 619 bp, Homo sapiens
  misc_feature: GZ8MTXP01EMLUR.21.26.C04.1.454.CMB.2.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (416)..(416): a, c, t, g, unknown or other
  misc_feature (416)..(416): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccacctctcctgcagggccagtcagattgttggacaacactacttagcctggtaccagcaagaaacctggccaggcctccgagctccnactccaatacncgcctaccaaggcggccagtggcacttcccagacgtgttcagtcggccagggtggtctgggactaagacctttcacttcctacacctatccaaccgtaagactagggacncgtagtagttagttagtttcgtacgttagtttacttacgtactaaccctaacctaacgtacttcgttaccttaccgacctaccgtccgtacgtacggtcgggtacgggtaacgggtacggagggtaaggaagttacgtaaacgaaacgtacgtggttacggcttacgaacctacgtaacttctcgttcttccgttccgttccg

SEQ ID NO: 329967 - DNA, 589 bp, Homo sapiens
  misc_feature: GZ8MTXP01CHHEH.21.26.C04.1.454.CMB.2.raw
  modified_base (205)..(205): a, c, t, g, unknown or other
  misc_feature (205)..(205): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgtctcgaggggaaancgccacctctcctgcagggccagtcagattgtggacaacaactacttagcctggtaccagcaagaacctggccaggctcccaggctcctcatccatactgccctacgaagcgggcccaacgtggacctacttcccctaggaccagggtttccaaggtcggaccctagggtggggtctaggggaacaagtacttcgaacttcacaaccatcaaccagaccgtgacgtcctagactgtacttttgacttagtttaactactacgacctaactaacgtattcgtccttaccgactaccgtctacgtaccggtcggacgggacggaccgaggggtcgaagactacgaaacggtaactggttgcttagcacgtntctnttctcgctccg

SEQ ID NO: 329968 - DNA, 629 bp, Homo sapiens
  misc_feature: GZ8MTXP01AJLNH.21.26.C04.1.454.CMB.2.raw
  modified_base (341)..(341): a, c, t, g, unknown or other
  misc_feature (341)..(341): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaagagcccaccctctcctgcagggccagtcagtattgtggacaaacaactacttagcctggtaccagcagaactggccaggctccagctcctcatccatactgccctaccaaggcggccacgtggcactccctgacnggttcagtggccaggtgggtctgggacaagtaccttcactctacaccatccaccgagtaccgtggactccgtagtattgttagttttcgactttaagtttacttacgtaccgaccctaaccgtaaacgtcgttccgttcctttaccggaccctacccgtccgtaccggtaccgggttccgggacggggtaaccgggtaccggtagggggtcgaacgttacgtaaccgaaacggtcgtgggttcgcttacggcctacctgttcgtcgttccttcgttaaccgttccccg

SEQ ID NO: 329969 - DNA, 585 bp, Homo sapiens
  misc_feature: GZ8MTXP01DZVTN.21.26.C04.1.454.CMB.2.raw
  modified_base (206)..(206): a, c, t, g, unknown or other
  misc_feature (206)..(206): n is a, c, g, or t
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagttagattgtggacaacactacttagcctggtaccagcagaacctggccaggcncccaggctctcatccatactgccctcaagagggcccagtggccatcccctgactaggttcaggtggctaggtcgggtctggggaccaggtaaccttcnctctccaaccatccaccagactggatcctgatgtatttgacttagtttatactcgacctaacaactagttcgtctttccgacctaccgtcctcgtacggttcgggcgggaacgggtaccgaggggtgaagtattacgaaacgttacgtggtacggttcttcggacctaactattccgttgtaccttctaacgttcccttaacccg

SEQ ID NO: 329970 - DNA, 584 bp, Homo sapiens
  misc_feature: GZ8MTXP01B3JIN.21.26.C04.1.454.CMB.2.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (405)..(405): a, c, t, g, unknown or other
  misc_feature (405)..(405): n is a, c, g, or t
  modified_base (450)..(450): a, c, t, g, unknown or other
  misc_feature (450)..(450): n is a, c, g, or t
  modified_base (549)..(549): a, c, t, g, unknown or other
  misc_feature (549)..(549): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacacctgtctttgtctcgaggggaaangccacctctcctgcagggccagtcagtattgtggacaaactaactacttagcctagggtaccagcaagaaacctggaccaggcctcccaggcctccncactccatacncgcctacgaagcggccacgtgacactccctgacaggttcaggtcgcaggtggtctgggactagtactcgatctacacactcacagatggacncgtgattagtactttgacttaagtttcacgtcgaccaactaactnttcggtactttcgaccgtacccgtctaccgtaccgggttcggaccggggtacggaccgtaggggtaacggaacgagtacgaaacgtacgtggttaggcncgaacactaagtctagttcttaacttcgttccccg

SEQ ID NO: 329971 - DNA, 636 bp, Homo sapiens
  misc_feature: GZ8MTXP01CU51Y.21.26.C04.1.454.CMB.2.raw
  modified_base (206)..(206): a, c, t, g, unknown or other
  misc_feature (206)..(206): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccacctctcctgcagggccagtcagattgttggcaaacaactacttagcctggtaccagcagaaacctggccaggctcccaggctcctcatccatactgcctcaagcggccatggcatccctgactggttcagtgccaggtggtntgggacaagcttcactctcaccatccacagactggacncctgattgtattttgacttagtttattacgtcgtaccctaaccgtaactacttacgtcctttaccgacctacccggtcctaccggtaacccggtttccggggaccgggtaacgggggtacccgaagggggttaacggaacggttacgttaaccgaaaacggtaaccggttcgggttacggggttcttaccgggcctaaccctaacgttccgttcggtttacctttaaccgttaaccttttcccccg

SEQ ID NO: 329972 - DNA, 709 bp, Homo sapiens
  misc_feature: GZ8MTXP01EOMJ1.21.26.C04.1.454.CMB.2.raw
  modified_base (205)..(205): a, c, t, g, unknown or other
  misc_feature (205)..(205): n is a, c, g, or t
  modified_base (318)..(318): a, c, t, g, unknown or other
  misc_feature (318)..(318): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgctccgaggggaaancgccaccctctcctgcagggccagtcagtattgttggacaacaacttacgttagcctaggtaccagccaagaaacctggaccaggcctcccgaggtcctcctcactccatacncgaccctacgaaggcggccacgtcgactaccttcccgtagaccgtaggttaccaggtcggaccgtaggggttcgggtcgtacggggaaacctaacgttaccttccgaaccttcctacccgaacctacgtacccgaaccgaagttaccgtggtaaccgtccgtagtaacgttagtttacgttttacggtactttaaggttttaactaccgtacgtaacccctaaaccgtaagttacgttccgttccgtttacccgaccgtacccgtcgttaccgtaccgggttcggacgggtacggaccgtaggggtaacgaagttacgtaaaccgaaacggtacgtcggttcgcgttacgcgtaaacctcgttcggttcttacttcgttaaccgttccccg

SEQ ID NO: 329973 - DNA, 649 bp, Homo sapiens
  misc_feature: GZ8MTXP01B5UGE.21.26.C04.1.454.CMB.2.raw
  modified_base (576)..(576): a, c, t, g, unknown or other
  misc_feature (576)..(576): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccaggtgtcaccggagaagttgtcttgacgcagtctccaggcaccctgtctctgtctccgaggggaaatgttactctctcctgcaaggccagtcagagtgttggcagtcgacgttgcctaggtaaccaaacaaaactggaccaggcctcccagtctcctcgatctagtcgggctactcctacgaggtactcgaccggcactacccgagacgtaggttcagtcgaccccgaggtcgggtctgggactaagtaccttcgactactacgaactacgtacaaacaactacgtcggaccgtacgtaggtaacttagttttacgaccgtaagttacgttaacttaacgtggttacaagtaggttaggttaagttacgggttaacgtacctaaccgttacgtaccggtttccgggaccgtaacgggggaacctaagggtggaacgngttaccggagaccgtaaagtggttacggcgttcgaaccgtacctgttccctgttaccttccaacgtttccccg

SEQ ID NO: 329974 - DNA, 520 bp, Homo sapiens
  misc_feature: GZ8MTXP02IQ5TO.21.26.C04.1.454.CMB.2.raw
  modified_base (367)..(367): a, c, t, g, unknown or other
  misc_feature (367)..(367): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggccagttgctgggacagacttnactctcaccatcaccagactggagcctgatgattttgctagtttatactgccaccaaacatgctttcgcaccgctcacgttcggcggagggaccgagggtcggagagtacaaacgaaacgtagtggcgtgcgaccaatcttcgtcttctactc

SEQ ID NO: 329975 - DNA, 526 bp, Homo sapiens
  misc_feature: GZ8MTXP02JQLY6.21.26.C04.1.454.CMB.2.raw
  modified_base (206)..(206): a, c, t, g, unknown or other
  misc_feature (206)..(206): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgttggcaacaactacttagcctggtaccagcagaaacctggccaggctcccaggctcctcatccatactgcctccaagacgggccactggcatccctgacaggttcagtggccaggtgggtctggggacagacttcactctcaccatcaccngactggagcctgatgtatttgctagtttattactgccaccaanatgctttcgcaccgctcacgttcggcggagggaccgagggtcggagagtacgaaacgaacgtgtacggctgcgaccatctgtcttcacttcccg

SEQ ID NO: 329976 - DNA, 519 bp, Homo sapiens
  misc_feature: GZ8MTXP02F0EI2.21.26.C04.1.454.CMB.2.raw
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgtggcaacaactacttagcctggtaccagcagaaacctggccaggctcccaggctcctcatccatactgcctccaagagggccactggcatcccctgacaggttcagtggccagtgggtctggggacagacttcactctcacccatccaccagactggagcctgatgtatttgctagtttatactgaccacaacatgctttcgctaccgctcacgttcggcggagggaccgagggtcggagatacgaaacgaactgtacgctgcacatctgtctcacttccc

SEQ ID NO: 329977 - DNA, 517 bp, Homo sapiens
  misc_feature: GZ8MTXP02GOIJB.21.26.C04.1.454.CMB.2.raw
  modified_base (206)..(206): a, c, t, g, unknown or other
  misc_feature (206)..(206): n is a, c, g, or t
  modified_base (312)..(312): a, c, t, g, unknown or other
  misc_feature (312)..(312): n is a, c, g, or t
  modified_base (426)..(426): a, c, t, g, unknown or other
  misc_feature (426)..(426): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgttggcaacactacttagcctggtaccagcagaaacctggccaggctccaggctcctcatccatactgcctcaagnggccactggcatccctgacaggttcagtggccagtgggtctgggacagacttcactctcaccatcaccagactggacgcctgatgtatttgctagtttattactgaccaacaanatgactttcgcaccgctcacgttcggcggtagggaccgaggggtggagagtcgaaaacgactggtacgctgcaccatctgtcttcacttcc

SEQ ID NO: 329978 - DNA, 564 bp, Homo sapiens
  misc_feature: GZ8MTXP02H90MU.21.26.C04.1.454.CMB.2.raw
  modified_base (207)..(207): a, c, t, g, unknown or other
  misc_feature (207)..(207): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
tcagtcgtcgctcgcacgaccggtgctcgatttagtctagcgactttgggtttggggagagaagagctgctcagttaggacccagagggaaccatggaaaccccagcgcagctttctcttcctcctgctactctggctcccagataccaccggagaaattgtgttgacgcagtctccggacaccctgtctttgtctccaggggaaangccacctctcctgcagggccagtcagattgtggcaacactactagcctggtaccagcagaacctggccaggctcccaggcctcctcatccatactcgcctacaaagacgggccagtggcctatcccctgactaggttcaggtggtagtggtctgggacngtacttcnctctcaccatcacanacnganctgatgatttgctagtttatactcgacaactaanatgtctttacgctaccgctaccgacggttcggacgggtacgggaccgtaggggtcgaaggaacgtacgaaaacgtaacgtaggtcggcttagaccgaaccgtatcgttacgttcctttacctactttcctccccg

SEQ ID NO: 329979 - DNA, 562 bp, Homo sapiens
  misc_feature: GZ8MTXP02FLRVY.21.26.C04.1.454.CMB.2.raw
  modified_base (206)..(206): a, c, t, g, unknown or other
  misc_feature (206)..(206): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (379)..(379): a, c, t, g, unknown or other
  misc_feature (379)..(379): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgtggcaacaactacttagcctggtaccagcagaacctggccaggctcccaggctcctcatccatactgcctccaagcggccacgtggcatcccngacnggttcagtggccagtggtctgggacagacttcgactctacaccntaccacagactggacgcctgatgtatttgctagtttacttactgaccctaaccaactatcgtacctttcggacctacccgtctcgaccggttcgggccgggacggggaccgaggggtacggagtactacgaaaacgacgtcgtcggactcgaacgtaccacttctcgtccttctactttcccg

SEQ ID NO: 329980 - DNA, 520 bp, Homo sapiens
  misc_feature: GZ8MTXP02I2EJF.21.26.C04.1.454.CMB.2.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccacctctcctgcagggccagtcagattgttggcaacactacttagcctggtaccagcagaaacctggccaggctccaggctcctcatccatactgcctccaagnggccatggcatccctgacagttcagtgccagtggtctgggacagacttcactctcaccatcaccagactgacgctgatgtatttgctagtttatactgcaccaacatgtctttcgcctaccgctctacgttcggcggtagggaccgagggtaggagacgtacgaaacgaacgtgtacgctgcgaccactctgtcttactacttcccg

SEQ ID NO: 329981 - DNA, 612 bp, Homo sapiens
  misc_feature: GZ8MTXP02IW9KJ.21.26.C04.1.454.CMB.2.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagtcgtcgctcgcacgaccggtgctcgatttagtctagcgactttgggtttgggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccacctctcctgcagggccagtcagattgtggcaacactacttagcctggtaccagcagaaacctgcaggctccagctcctcatccatacngcctcaagcggccacgtgcactccctgactaggttcagtggcctaggtggtctgggacagtacttcgactctaccaccatccaccagactggacnctgatgtatttgcttagtttattactcgtacccaacctaaactagttcgtaccttttccggacctaccccgtcttaccgtaccgggttccgggacgggtacggggtaacccgtagggggttcgggaaacgacgtaaccgaaaaacggtaacgtcgggtacggtccgtacgaacccgtaacctaacgttccgtaggtttccctttactaactttcccccg

SEQ ID NO: 329982 - DNA, 561 bp, Homo sapiens
  misc_feature: GZ8MTXP02HJB7D.21.26.C04.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgtggcaacaactacttagcctggtaccagcagaacctggccaggctccaggctcctcatccatactgcctccaagcggccactggcatccctgacaggttcaggtgcctaggtgggtctggggacaggtacttcacttctacaccatccaccagactggacgcctagatgtattttgacttagtttattactcgacctaactaacattcgtactttccgactaccgctacgtacggttcggcgggacgggacgaggggtacggagatacgaaacggacgttggacgtactacgaacgtactacgtctcgtacttctacttcccg

SEQ ID NO: 329983 - DNA, 539 bp, Homo sapiens
  misc_feature: GZ8MTXP02HZSG4.21.26.C04.1.454.CMB.2.raw
  modified_base (206)..(206): a, c, t, g, unknown or other
  misc_feature (206)..(206): n is a, c, g, or t
  modified_base (391)..(391): a, c, t, g, unknown or other
  misc_feature (391)..(391): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtgcaacactactagcctggtaccagcagaacctggccaggctcccaggctcctcatccatactgcctccaagcgggccatggcatccctgacaggttcagtggccaggtgggtctggggacaggtacttcacttctcaccatcacagactggancctgatgtatttgctagtttattactgaccaccaactattcgtactttcgcctacccgctcgtacggttcggcgggtacgggaccgaggggtcggagatacgaaaacgaactcgtacggctagcgaccattctgtacttcactttccc

SEQ ID NO: 329984 - DNA, 597 bp, Homo sapiens
  misc_feature: GZ8MTXP02HK0DJ.21.26.C04.1.454.CMB.2.raw
  modified_base (206)..(206): a, c, t, g, unknown or other
  misc_feature (206)..(206): n is a, c, g, or t
  modified_base (408)..(408): a, c, t, g, unknown or other
  misc_feature (408)..(408): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacaactacttagcctggtaccagcagaaacctggccaggctcccaggcctcctcatccatactgcctccaaggacgggccactgggcactccctgactaggttcaggtggcctagttggtctggggacaggtacttcacttctccacctatccaccagactggacncctgatgtattttgcttagtttattactgacccaacctaaactattcgtactttcgacctacccgtctccgtaccggttcgggacgggtacgggtaccgagggggtacggacgtacgtacgaaaacggtacgtggtacggtaccgtcggaacctaccgtacgttcgtacgttccttacgtactttcccg

SEQ ID NO: 329985 - DNA, 500 bp, Homo sapiens
  misc_feature: GZ8MTXP02IKCNV.21.26.C04.1.454.CMB.2.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (488)..(488): a, c, t, g, unknown or other
  misc_feature (488)..(488): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacactactagcctggtaccagcagaaacctggccaggctcccagctcctcatccatactgcctcaagnggccatggcatccctgacaggttcagtgccagtggtctgggacagacttcactctcaccatcaaccngactgancctgatgtatttgctagtttatactgaccacaacatgctttcgcaccgctcacgttcggcggagggaccagggtcgagatacaaacgactgacgctgcacatcngtctctatcccg

SEQ ID NO: 329986 - DNA, 599 bp, Homo sapiens
  misc_feature: GZ8MTXP02GY4WA.21.26.C04.1.454.CMB.2.raw
  modified_base (206)..(206): a, c, t, g, unknown or other
  misc_feature (206)..(206): n is a, c, g, or t
  modified_base (398)..(398): a, c, t, g, unknown or other
  misc_feature (398)..(398): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccagacaccctgtctttgtctccaggggaaanagccaccctctcctgcagggccagtcagattgtggcaacaactacttagcctggtaccagcagaacctggccaggctccgagctcctcatccatactgcctcaaggacggccacgtggcactccctagactaggttcaggtcggcaggtgggtctggggacagtcttcactctcactatccacagctggacncctgattgtattttgacttaagtttactacgtcgacctaaccgtaactattcgtcctttacgacctaccgtctacgtacggtttccgggacggggtacgggacccgtagggggtacggaacgtacgtaaccgaaaacggtacgtcggtacggaccgtaaggaccctaaccgtacgttccgttacggttcctttactacccg

SEQ ID NO: 329987 - DNA, 532 bp, Homo sapiens
  misc_feature: GZ8MTXP02F0Z3O.21.26.C04.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacaactacttagcctggtaccagcagaactggcaggctccaggctcctcatccatactgcctcaagcggccactggcatccctgacaggttcagtggccaggtgggtctggggacagacttcactctcaccatcaccagactggacgcctagatgtatttgctagtttatactgacctaaccaatatgtcctttcgactaccgtctacacggttcggcggacgggaccgtagggtacggagactacgaaacgtactggtacgctgcgaccatctagtctcgtacttcccg

SEQ ID NO: 329988 - DNA, 590 bp, Homo sapiens
  misc_feature: GZ8MTXP02JUF3D.21.26.C04.1.454.CMB.2.raw
  modified_base (206)..(206): a, c, t, g, unknown or other
  misc_feature (206)..(206): n is a, c, g, or t
  modified_base (399)..(399): a, c, t, g, unknown or other
  misc_feature (399)..(399): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgttggcaacaactacttagcctggtaccagcagaaacctggccaggcctccaggctcctcatccatactgccctcaagcgggccactggccatcccctgacaggttcagtggccaggtgggtctggggacagacttcactctcaccatcaccagactggacncctgatgtatttgcttagtttatactcgtaccacctaactatcgtctttcgactacccgtctccgtacggttccgggcgggtaacgggaccgaggggttcggaacgtacgtaaccgaaaaccggtaacgttcggtacggtacctacggaaccgtaaccgtacttccgtacgttcctttacgactttccccg

SEQ ID NO: 329989 - DNA, 519 bp, Homo sapiens
  misc_feature: GZ8MTXP02GZFVJ.21.26.C04.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtctagcgactttgggtttgggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgtggcaacaactactagcctggtaccagcagaaacctggccaggctcccaggctcctcatccatactgcctccaagacggccactggcatccctgacaggttcagtgccagtggtctgggacagacttcactctcaccatcaccagactggagcctgatgtatttgctagtttatactgaccaccaacatgactttcgcacccgctacacgttcggcggtagggaccgaggggtcgagagtacaaacgactgtcgctgaacaccatctgtcttacgacttccg

SEQ ID NO: 329990 - DNA, 615 bp, Homo sapiens
  misc_feature: GZ8MTXP02GH7AD.21.26.C04.1.454.CMB.2.raw
  modified_base (207)..(207): a, c, t, g, unknown or other
  misc_feature (207)..(207): n is a, c, g, or t
  modified_base (593)..(593): a, c, t, g, unknown or other
  misc_feature (593)..(593): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaangcccacctctcctgcagggccagtcagattgtgcaacactacttagcctggtaccagcagaaacctggccaggcctccaggcctcctcatccatactcgcctcaagcgggccagtggccatccctgacaggttcaggtgcctaggtgggtctggggacaggacttcactctacaccatcaccagaccgtgacgcctgatgtattttcgacttaagtttacttacgtcgacctaaaccaactattcggtcctttaccggccctaacccggtctaccggtaccggtttcgggaccgggtaacggggacccgtagggggtggaacggtacttaaccgaaaacggtacgttggtacgggtacctaggaacctaacccgtagttccggttntaccctttacgtactttccccg

SEQ ID NO: 329991 - DNA, 620 bp, Homo sapiens
  misc_feature: GZ8MTXP02JMCUH.21.26.C04.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccacctctcctgcagggccagtcagattgttggcaacaactacttagcctggtaccagcagaacctggccaggctccaggcctcctcatccatactgcctaccaaggacggccacgtggaccatccctagacaggttcagtcggccaggtcgggtctggggacagacttacgctacaccatacaccagactgacgtccgtagatacgtagtttagcttaagtttattaactcgtacctaaccaactatacgtctttaccgcgacccgtctaccgtaacggttccggtacgggacgggtaccggtacggggtagggaacgtaaacgtaccgaaaacggtaaacgtagggtcggtacctaggaccaaccgtacgtccggttactaccgtttaccgtaacttccctttaccccgg

SEQ ID NO: 329992 - DNA, 627 bp, Homo sapiens
  misc_feature: GZ8MTXP02JVFFC.21.26.C04.1.454.CMB.2.raw
  modified_base (206)..(206): a, c, t, g, unknown or other
  misc_feature (206)..(206): n is a, c, g, or t
  modified_base (336)..(336): a, c, t, g, unknown or other
  misc_feature (336)..(336): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtgcaacactactagcctggtaccagcagaacctggccaggcctccaggcctcctcactccatactcgccctccaaggcggcccatgggaccactcccgngacgaggttcaggtggcccgtaggtgggtctaggggactacggtacttcgacttcaccaccataccaccgagaccgtaggactccgtaggactgttactttcgactttaagttttactacgtacgtacccaaccgtaaacgtcgtaggttaccctttaccggacccgtacccgtccgttaccggtaccgggttcggggaccgggtacgggaccgaggggtacgaggtactaacgaaaacgtacgtggtacggactcggaacctaccgtattccgtatcctactacttcccg

SEQ ID NO: 329993 - DNA, 528 bp, Homo sapiens
  misc_feature: GZ8MTXP02HXR6H.21.26.C04.1.454.CMB.2.raw
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgtggcaacactatagcctggtaccagcagaaacctggccaggctcccaggcctctcatccatactgcctcaagnggccatggcatccctgacaggttcagtgccagttgntgggacagacttcatctacaccatcaaccagactgacncctgatgtattttgacttagtttattctgacccacgaactatcgtcttcgacctacgctactacggttcggacggaggaccgagggtcggagactacgaaacgacgtcgcggtactgccacgtactctgtctacgtactcccg

SEQ ID NO: 329994 - DNA, 541 bp, Homo sapiens
  misc_feature: GZ8MTXP02JKU4E.21.26.C04.1.454.CMB.2.raw
  modified_base (204)..(204): a, c, t, g, unknown or other
  misc_feature (204)..(204): n is a, c, g, or t
  modified_base (386)..(386): a, c, t, g, unknown or other
  misc_feature (386)..(386): n is a, c, g, or t
  modified_base (491)..(491): a, c, t, g, unknown or other
  misc_feature (491)..(491): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccagggaaangccacctctcctgcagggccagtcagattgtgcaacaactacttagcctggtatcagcagaaacctggccaggctcccaggcctcctcatccatactgcctacaagacggccatgcatccctgactggtcagtcggacaggtggtctgggacagccttcactctacaccatcgaacagtacngacgctagatgtactttgacttagttacttactcgacctaacaaactatcgtacctttcgacctacccgtctactacggttcggcggaaggaccagggggtaganacgtaacaaaacgtactgtaggctgaccacctatcgtcttacctagtacc

SEQ ID NO: 329995 - DNA, 548 bp, Homo sapiens
  misc_feature: GZ8MTXP02F3WK8.21.26.C04.1.454.CMB.2.raw
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaanagccaccctctcctgcagggccagtcagattgtgcaacaactacttagcctggtaccagcaagaacctggccaggctccaggctcctcatccatactgcctacaagcggccactggcatccctgaccagttcaggtggccaggtggtctggggacagtacttcactctacaccntacacagacgtggacncctagattgtatttgcttaagtttatacgtntaccaacctaaantcgtactttcgacctaccgtctacgtacggttcggcggacggacgagggtcgaagactacgaaaacgtacgtggtacgctagccgacctatcgtctctacactttcccg

SEQ ID NO: 329996 - DNA, 581 bp, Homo sapiens
  misc_feature: GZ8MTXP02I4OHG.21.26.C04.1.454.CMB.2.raw
  modified_base (206)..(206): a, c, t, g, unknown or other
  misc_feature (206)..(206): n is a, c, g, or t
  modified_base (380)..(380): a, c, t, g, unknown or other
  misc_feature (380)..(380): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacaactacttagcctggtaccagcagaaacctggccaggctccaggctcctcatccatactgcctccaagacggccactggcactccctgaccaggttcagtggccagtggtctggggacaggacttcactctcaccntcacagactggacgcctgattgtattttgacttagtttacttactcgaccaacctaacacttgtcctttcgacctacccgcttccgtacggttcgggcgggtacgggaccgtaggggtacggaagtaacgtacgaaaacggaacgtcggtacggtctacggaaccgacccgtatacgttacgttctttacgaactttcccg

SEQ ID NO: 329997 - DNA, 540 bp, Homo sapiens
  misc_feature: GZ8MTXP02HSYDW.21.26.C04.1.454.CMB.2.raw
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccacctctcctgcagggccagtcagattgtgcaacactactagcctggaccagcagaacctgcaggctccagctcncatcatacngcctccaagacggccacgtggcatccctgacagttcagtggccagtgggtctgggacagacttcactctcaccatcaaccagacctggacncctagatgtattttgacgttagtttattactcgaccaccaanattcgtctttacgctaccgtctcgaccggttcggacggtacgggaccgtagggtggacgtacacgaaacggtaacgtcgtcggactcgaacgacctatcgtatctctacttcccg

SEQ ID NO: 329998 - DNA, 546 bp, Homo sapiens
  misc_feature: GZ8MTXP02F3C86.21.26.C04.1.454.CMB.2.raw
  modified_base (205)..(205): a, c, t, g, unknown or other
  misc_feature (205)..(205): n is a, c, g, or t
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaangccaccctctcctgcagggccagtcagattgtggcaacactcttagcctggtaccagcaagaacctggccaggctccaggcctcctcatccatactgcctacaagacggccagtggcatcccngacaggttccagtggcctaggttggctggggacagacttcgactctacaccntcaacctagacctggacnccgtagactgtatttgctagtttatacgtgaccaaccaactatcgtctttcgccaccgtctcgacgttcggcggtacggacgagggtcggagactacgaaacgtactggtacgctacgaactacgattcctagtccttcactttcccg

SEQ ID NO: 329999 - DNA, 530 bp, Homo sapiens
  misc_feature: GZ8MTXP02F23DR.21.26.C04.1.454.CMB.2.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (386)..(386): a, c, t, g, unknown or other
  misc_feature (386)..(386): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaangccaccctctcctgcagggccagtcagattgtgcaacactacttagcctggtaccagcagaactggccaggctccaggctcctcatccatacngcctcaagacggccactggcatcccngacaggtcagtgccagtggtctgggacaggacttcactctacaccatccaccagactggacncctgatgtatttgctagtttatactgacccacaactatgtctttcgcctaccgctactacggttcggcggacgggaccgaggggtcggagatacgaaaacgacgtcggtcggctaggccaacgtctacgtgtcctcacttcccg

SEQ ID NO: 330000 - DNA, 538 bp, Homo sapiens
  misc_feature: GZ8MTXP02JW676.21.26.C04.1.454.CMB.2.raw
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (424)..(424): a, c, t, g, unknown or other
  misc_feature (424)..(424): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccaccctctcctgcagggccagtcagattgtggcaacactcttagcctggtaccagcagaaacctggccaggctccaggctcctcatcatacngcctcaagnggccatggcatccctgactaggttcaggtggccaggtgggtctggggacagtacttcactctcaccatccacagctgagcctgatgtatttgctagtttatactgaccacaacntgtcttcgcaccgctcgacgttcgggacggacgggaccgaggggtacgagtacgtacgaaacgacgtaggcgtactcgaacctaccgacgttcgtacgttccttacacttcccg

SEQ ID NO: 330001 - DNA, 573 bp, Homo sapiens
  misc_feature: GZ8MTXP02JJQT8.21.26.C04.1.454.CMB.2.raw
  modified_base (205)..(205): a, c, t, g, unknown or other
  misc_feature (205)..(205): n is a, c, g, or t
  modified_base (389)..(389): a, c, t, g, unknown or other
  misc_feature (389)..(389): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaangccaccctctcctgcagggccagtcagattgtgcaacactacttagcctggtaccagcagaacctggccaggctccaggcctcctcatccatactcgcctcaagcggccacgtggcactccctgacaggttcagtgccagtggtctgggacagacttcgactctacaccatcaccagactgacnctgatgtatttgactagtttatactcgtaccacctaatactcgtactttaccgcctaccgtctccgtacggttcggcgggtacgggaccgtaggggtcgaagacgtaccgaaaacggtaccgtaggtacggtacgtacgaaccgtaaccgtacgttaccgtcggttaccttactacgtttcccg

SEQ ID NO: 330002 - DNA, 591 bp, Homo sapiens
  misc_feature: GZ8MTXP02F05UQ.21.26.C04.1.454.CMB.2.raw
  modified_base (207)..(207): a, c, t, g, unknown or other
  misc_feature (207)..(207): n is a, c, g, or t
  modified_base (407)..(407): a, c, t, g, unknown or other
  misc_feature (407)..(407): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaangcccaccctctcctgcagggccagtcagattgttggcaacactacttagcctggtaccagcagaacctggccaggctccaggctcctcactccatactgcctcgaagacggccacgtggccactcccctgacctaggttcaggtggcctaggtcgggtctggggacaggtcttcactctacaccatcaccagactggacncctagatgtatttgacttagtttattacgcgtacccacctaaactctcgtactttaccgacctaccgtctacgtaccgggttccgggacgggtacgggaccggtagggtcggaagtactacgaaaacgtaacgtggtacggcttacggaacctacgtacgttcgtctcttaccgactttccccg

SEQ ID NO: 330003 - DNA, 679 bp, Homo sapiens
  misc_feature: GZ8MTXP02H3D0S.21.26.C04.1.454.CMB.2.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagnttgttggcaacactacttagcctggtaccagcagaaacctggccaggctccaggctcctcatccatacngcctaccaagacgggccactggcatccctgactaggtcagtggccaggtgggtctggggacaggacttcacttctaccaccatcaaccagacctggacgccctaggtacttgtactttttggacttaagtttaacttacgtacgtaccctaaaccctaaacctaacgttccgttaccgtttccgacccgtaacccgtccgtttaccgtaaccgggtttccggggacccgggggtaaacgggggacccggtaacgggggttaggaaacggtaacggttaaacggaaaaacggtaaaccgttcggggtaacgggtccttacgggtaacccgaacctaacgtttcccgttaggttccctttaccgaacttttcccccgg

SEQ ID NO: 330004 - DNA, 580 bp, Homo sapiens
  misc_feature: GZ8MTXP02HZVON.21.26.C04.1.454.CMB.2.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagtattggttggcaacaactacttagcctggtaccagcagaaacctggccaggctccagcctcctcatccatacngcctccaagacgggccatggcactccctgacnggttcagtgccaggtggtctgggacagtcttcactcacaccatcacagacnganctgatgtatttgctagtttatactcgaccaaccaactattcgtcctttccggacctacccgtctaccgtacggttcgggcgggtaacggggccgaagggggttcggaaggtacgtaacgaaaaccggaacgtcggtacggtcgtacggccgtacccgtaagttcctggttcctttacgacctttcccg

SEQ ID NO: 330005 - DNA, 568 bp, Homo sapiens
  misc_feature: GZ8MTXP02I1MV2.21.26.C04.1.454.CMB.2.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaaggggaaangccacctctcctgcagggccagtcagtattgttggacaaanaactacttagcctggaccagcaagaaaccnggaccaggctccagctccnatccatacngcctacaagacggccaagtggcatccctagacaggttcagtgccagtggtctgggacagacttcactcacaccatcacanactganctgatgtatttgacttaagtttactactcgaccaacaactagtgtacctttcgacctacgtctacgtaacggttcggaccggtaacgggaccgaaggggtggaacgagtaaccgaaaaacgacgttaggacggactacggaacaccgtaagttcgtacgttctaactactttcccg

SEQ ID NO: 330006 - DNA, 522 bp, Homo sapiens
  misc_feature: GZ8MTXP02FO1I5.21.26.C04.1.454.CMB.2.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaanagccaccctctcctgcagggccagtcagattgtggcaacactacttagcctggtaccagcagaaacctggccaggctcccaggctcctcatccatactgcctcaagnggccactggcatccctgacaggttcagtggccagtggtctgggacagacttcactctcaccntccaccagactggagcctgatgtatttcgctagtttatactgacctaaccaacatgctttcgcaccgctcacgttcggcggacggaccgagggtacggagatacaaacgaactgtacggcgtgcgaaccatctgtactacacttcccg

SEQ ID NO: 330007 - DNA, 572 bp, Homo sapiens
  misc_feature: GZ8MTXP02IVKAQ.21.26.C04.1.454.CMB.2.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgtctccgaggggaaangccacctctcctgcagggccagtcagattgtgcaacatactagctggtaccngcagaactggcaggctccagctcctcatccatactgcctaccaaggcggccactggcactcctgacngttcagtgccaggtggtctgggacagcttcgctctcaccntcacanacgnganctgatgtatttgcttagtttactacgtcacctaaccaatgttcgttcctttcgacctacccggtctacgtaccgggtttacggcggggaacgggtaccggaaggggttcggacgaactacggaaaaaccgtgtcggttaggccgttacggaaccctaaccgtacgttcgttacgttcgttccgtactttccccg

SEQ ID NO: 330008 - DNA, 677 bp, Homo sapiens
  misc_feature: GZ8MTXP02GULFL.21.26.C04.1.454.CMB.2.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (389)..(389): a, c, t, g, unknown or other
  misc_feature (389)..(389): n is a, c, g, or t
  modified_base (570)..(570): a, c, t, g, unknown or other
  misc_feature (570)..(570): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaanagccaccctctcctgcagggccagtcagattgttggacaacaactactagcctggtaccagcaagaacctggccaggcctccaggcctcctcatccataccncnccctaccaaggacgggcccacgtggaccactcccctagaccgtaggttccagggttggcccgtagggtcggggttacgnggggtaaccaggttaccttccgaccttctaccaccctatcccaaaccgtagaaccgtggtacgtccctaggtattagttatttcgagtttaacgtttactacgtcaacctaacctaaactgttccgtactttccgactaccccgcttacggtacggttaccgggacggaacggggtaccgnggggtacgacggtaactaacgaaaacggtacgttacgggtaccggacgttaccggaacctaacccgttagttaccgttcgtttacctttaccgtaactttcccccgg

SEQ ID NO: 330009 - DNA, 550 bp, Homo sapiens
  misc_feature: GZ8MTXP02HI35L.21.26.C04.1.454.CMB.2.raw
  modified_base (206)..(206): a, c, t, g, unknown or other
  misc_feature (206)..(206): n is a, c, g, or t
  modified_base (400)..(400): a, c, t, g, unknown or other
  misc_feature (400)..(400): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaanagccacctctcctgcagggccagtcagattgtgacaacaactattagcctggtaccagcaagaaacctggccaggctcccaggctcctcatccatactgcctaccgaagacggccaatggcactcccgtagacaggttcaggtggccagttgctgggacagacttcactctccaccatcaaccagtactggacncctgatgtatttcgacttagttatactcgacaccaaangttcgactttcgactaccgntacgtacggttcggacggaggaccgagggtcgagtataaccgaaaagtactgacggctcgaacgacctatcggttctcttacgtactccccg

SEQ ID NO: 330010 - DNA, 505 bp, Homo sapiens
  misc_feature: GZ8MTXP02FGBF3.21.26.C04.1.454.CMB.2.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgctccaggggaaangccacctctcctgcagggccagtcagattgtggcaacaactacttagcctggtaccngcagaaacctggccaggctccaggctcctcatccatactgcctccaagngggccactggcatccctgacaggttcagtggccaggtggtctggggacagacttcactctcaccatcaccagactggancctgatgtattttgctagtttatactgccaccaacatgctttcgcaccgctcacgtcgcggagggcagggtgagntacaaacgaacngtcggctgcacatctgtcttcacttccc

SEQ ID NO: 330011 - DNA, 625 bp, Homo sapiens
  misc_feature: GZ8MTXP02JYZEI.21.26.C04.1.454.CMB.2.raw
  modified_base (206)..(206): a, c, t, g, unknown or other
  misc_feature (206)..(206): n is a, c, g, or t
  modified_base (337)..(337): a, c, t, g, unknown or other
  misc_feature (337)..(337): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagatacccaccggagaaattgtgttgacgcagtctccggacaccctgtctttgctccaggggaaanagccaccctctcctgcagggccagtcagtattgttggcaacaactactagcctggtaccagcagaacctggccaggctcccagcctcctcatccatactgccctacaaggcggccacgtggccactccccngactaggttccaggtcggccctaggtcggggtctaggggaccaggtacttcgaccttccgtacaccgatccaccgtagacctggactcctagatgtatttgacttagttttacttacgtcgacccaacgtactacttcgtacctttccggacctacccgtccttaccgtaaccgggtttccggggaccggggtaacggggacccgtaagggggtcgaacggactaaccgaaaaccggtacgtggtcgcggtacgccgaacgtactcgtcgttccttacgctttccccg

SEQ ID NO: 330012 - DNA, 556 bp, Homo sapiens
  misc_feature: GZ8MTXP02FQAXT.21.26.C04.1.454.CMB.2.raw
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
  modified_base (496)..(496): a, c, t, g, unknown or other
  misc_feature (496)..(496): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccgaggggaaagagccaccctctcctgcagggccagtcagattgtggcaacaactacttagcctggtaccagcaagaacctggccaggctcccagcctcctcatccatactcgcctccaagcggccacgtggcactcccngacagtcagtggccaggtggtcgtggggcagcttcgactctcaccatcaccatacgtggacncctagattgtatttcgacgttagttttactactcgacctaccaacgtatcgtccttacgccaccgctcgacggttcggcggtaggccgtaggggtcganacgtacgaaaacgcgtcggtggactcggaaccaactcgtctcgtaccttcgtctttcccg

SEQ ID NO: 330013 - DNA, 509 bp, Homo sapiens
  misc_feature: GZ8MTXP02H2LZ5.21.26.C04.1.454.CMB.2.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaangccaccctctcctgcagggccagtcagattgtggcaacaactacttagcctggtaccagcagaaacctgcaggctccaggcncnatccatactgcctcaagcggccactggcatcccngacaggttcagtgccagtggtctgggacagacttcactcncacatcacnactganctgatgtatttgacttagttacttactgaccactaacattgctttcgctaccgntcgacgttcggcggaggtaccaggggtcganagtacaaaagacngtacgntacgcacatctagtcctcacttcccg

SEQ ID NO: 330014 - DNA, 564 bp, Homo sapiens
  misc_feature: GZ8MTXP02ILWUV.21.26.C04.1.454.CMB.2.raw
  modified_base (205)..(205): a, c, t, g, unknown or other
  misc_feature (205)..(205): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (507)..(507): a, c, t, g, unknown or other
  misc_feature (507)..(507): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctccagataccaccggagaaattgtgttgacgcagtctccggacaccctgtctttgtctccaggggaaanagccacctctcctgcagggccagtcagattgttggcaacaactacttagcctggtaccagcaagaaacctggccaggctccgaggcctcctcatccatactgcctacaagcggccagtggcactccctgacnggttcagtggcctagtgggtctggggacagcttcactctcaccntcacagctgacncagatgtatttcgcttaagttttactactcgacccaaaccgaaactcttcgtacctttcgaccctacccgtcttcgtacggttcgggaccgggtaggaccgaggggtgaacganaacgtaaaacgactggtacgtctgaaccgacctattccgtgttctactactttcccg

SEQ ID NO: 330015 - DNA, 614 bp, Homo sapiens
  misc_feature: GZ8MTXP02HSZT7.21.26.C04.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
tcagtcgtcgctcgcacgaccggtgctcgatttagtctagcgactttgggtttggggagagaagagctgctcagttaggacccagagggaaccatggaaaccccagcgcagcttctcttcctcctgctactctggctcccagataccacggagaaattgtgttgacgcagtctccggacacctgtctttgtctcgagggaangccacctctccngcgagggccaggtcagtattgtgacaacaacttacttagctaggtaccagacaagaaacctggaccaggcctacccgagccncctacactccgattacgcgcctacagacggccagtcggctactcccngactgttnaggtggcagggtcgtgtacggntacgacttcactctcaccganctaccagcgtagacgtctagattgttatttcgntttaagtttactactacgtaccctactaaactcttcgttaccttccgacctaccgctacggtccggttcggggacggtaacgggaccggacggggtacggaagtaccgtaaacggaaaacggttacgtagggttaccgcgtacgcgtaaccctagttcttacgtttacctcgttaaccgttcccccg

SEQ ID NO: 330016 - DNA, 533 bp, Homo sapiens
  misc_feature: GZ8MTXP01CV9OL.52.25.C03.1.454.CMB.2.raw
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagcagttattagctggtancagacaaaacagggaacncccctaagctcctgatctatggtnacatctaacttttgaccgtaaagggtcgggtacccagtccgaaaggttcaaggcggcaggttcgggatcgtagggactaagaattcaactctacacaatcagcagcctgacagcctagaagtnttttagactaattatctanacaaactacttaatacgttactcttacactttcggccctaagggaaccaaaggtcgaactagtcaaaacggcttgtgctcgcaccttntcgttntc

SEQ ID NO: 330017 - DNA, 588 bp, Homo sapiens
  misc_feature: GZ8MTXP01DFF63.52.25.C03.1.454.CMB.2.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcagttattagcctgancagacaaaaacngggaaacncccctaagctcctgatctatgtgcatactaactttagacgaaggtacgggtacccgatactaacggttacgagcggcgagtaggagtcgtgggaacgagtatactactactacacaactacacgacacgacgtacgacgacgacgtagtaagtattacgtactaacgttaacttaacttacgtaactaaactaacttaaacttaacgttaccttaccttaccttaccgttaccgtaccgtaacggtaacgaaacgtacgacgtaactaacgttaaacgttaacgttacgtaagtcgtcgacacttactcgttcgtc

SEQ ID NO: 330018 - DNA, 632 bp, Homo sapiens
  misc_feature: GZ8MTXP01D40I2.52.25.C03.1.454.CMB.2.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttctgtctgcatctgtagganacagtgtcacatcacttcgccgggcagtcgagggcattagctagttatttagcctggtancaagacaaaaaccgngggaaacgcccctaaagctcctgatctatggtncatctaaactttgacgtaaggtcgggtaccagtctaacggttcagtcggnaggtgatcgngggaacagtaacttcactctacaataacncagcacgcctacgactacgtaccgtaagtaacgttactttacgaaccttaaacgtttacttaccgtacgtaaacctaaacctttaaacctttaactttaaccgtttaccttaccgttaccgttaacccgtttccggtacccggtaaagggtaaaccgttaaaggtcgttaaacgtaaacgtaaaccgaaacgttcgttacgggtcgactaacgaacctacttacttccgttcgttaacc

SEQ ID NO: 330019 - DNA, 613 bp, Homo sapiens
  misc_feature: GZ8MTXP01C4U3K.52.25.C03.1.454.CMB.2.raw
  modified_base (251)..(251): a, c, t, g, unknown or other
  misc_feature (251)..(251): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccggcagtcagggcattagcagttattagctggtancagacaaaacaggaaacgcccctaagctccagatctagtgtgacagtctaaactttgacgtaaggtcgggtcccagtaccgaaggttcaggcgganacggttggatcgtagggaacagtaacttcacttcacanaatcaagcancctgctagcctagaatactttagacttaaacttcggttactataccaaacttaacccggtttaaatacgtttaaacccttccttaccgttaccgtttcgggtacccccttgggggaaacccttaaaaggggttcgaaccctaaggtaaccttaaaaccgttaacgttgggttcggaaccgttcgtaacccaccgttaagttcccgttttcgttaaccc

SEQ ID NO: 330020 - DNA, 608 bp, Homo sapiens
  misc_feature: GZ8MTXP01CO34K.52.25.C03.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtgacatccagttgaccagtctccatccttctgtctgcatctgtaggagacagatcacatcactgccggcagtcagggcattagcagttattagctgtancagacaaaacagggaaanccctaagctcctgatctaatggtanactatactaagttgacgtaggtcggtacctagtacgtaacggtcgagcggacgtaggtagagtcgtagggaacagtaactcactcacaactaanacacgacgacgacgtacgacgacgacgtagtaagtaagtttacgtaacttaaacgttaacttaacgttaacgtaactaaactaaacttaaacttaacgttaaccttaccttaccttaccgttaccggtaccggtaacggtaaccgttaaacggtaacgaacgtaaacgtaacgttaaacgttaacgttacgtaacgtacgtaacgactaccttacttcgttcgttc

SEQ ID NO: 330021 - DNA, 568 bp, Homo sapiens
  misc_feature: GZ8MTXP01BWFLH.52.25.C03.1.454.CMB.2.raw
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggcagtcagggcattagctagtttattagctggtancaagacaaaacgaggaacncccctaagctctgatctagtggtnctatctaactttggacgtaagggtcgggtacccagtcgaaacggttcaggtcggacaggtaggattcggtaggggaactagtaacttcactctacaacaatcagcagcctagcagcctagaaacgtntttacgacttaacttattactntactaaactacttaatacttacctcttactacgtttccggcccgtaagggaaccttaaaggtcgaactaacgtacaaaacgttagttcggtcgcctcgaccctacttattccgttgttcc

SEQ ID NO: 330022 - DNA, 676 bp, Homo sapiens
  misc_feature: GZ8MTXP01DRRAV.52.25.C03.1.454.CMB.2.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
tcagcgcagtacgacacgaccggtgctcgatttagtagtgtagatttgggtttggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcagttattagctggtancaagacaaaaaaaccngggaaaacgcccctaaagctcctgaatctaatggtanactatactaatttgacgtaagggtcgggtaccatacgtaaacggttcaaggcgganaggtaggatcgagggaacaagtaattcactcacaacaaatacacgacacgacgtacgacacgacgtagtaaagttaagtttacgttaacttaaacgtttaaactttaacttaacgttaacctaaaaccttaaaacctttaaaactttaaacgtttaacctttaccctttaccttaaccgtttacccggttacccggtaaccgggtaaaccggttaaaacggtaaacggttaaacgtaaacgtaaacgttaaaacgttaaaacgttacggtaacggtacgtaacgtacgtaaccttaacttaacgttcgttaac

SEQ ID NO: 330023 - DNA, 636 bp, Homo sapiens
  misc_feature: GZ8MTXP01EQ1BJ.52.25.C03.1.454.CMB.2.raw
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (462)..(462): a, c, t, g, unknown or other
  misc_feature (462)..(462): n is a, c, g, or t
tcagcgcagtacgacacgaccggtgctcgatttagtagtgtagatttggggtttggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttcgccggcagtcagggcattagctagttattagcctggtancaagacaaaaaccgagggaaacnccccctaagcctacctgattctagtggtagactaatctaacgtttggacgtaaggggttcgggtaccctagtacgtaacggttcgaaggcggacgtaggtacgggtaactcggtagggaaactagtaacttcactctacacaatccaacgctacgcctagaccctaagccgttagaaacgttnttttacgacttaaacgtttattacgtataacctaaaactacctttaaattcgtttaaacctccttcgtacccgtttcggcctaagggaaaccttaaaggtcgttaaactaacgttaaccaaacgttacgttggttaacgccttaacggaccccaacgttctcgtttcgtaaccc

SEQ ID NO: 330024 - DNA, 518 bp, Homo sapiens
  misc_feature: GZ8MTXP01ENY63.52.25.C03.1.454.CMB.2.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (400)..(400): a, c, t, g, unknown or other
  misc_feature (400)..(400): n is a, c, g, or t
  modified_base (510)..(510): a, c, t, g, unknown or other
  misc_feature (510)..(510): n is a, c, g, or t
tcagcgcagtacgacacgaccggtgctcgatttagtagtgtagatttgggtttgggggagtcagtcccagtcaggacacagcatggacatgagggtcccgctcagctcctggggctcctgctgctctggctcccaggtgccagatgtgacatccagttgacccagtctccatccttcctgtctgcattctgtaggagacagagtcaccatcacttgccggcagtcagggcattagcagttattagctggtatcagacaaaaaccgagggaaacncccctaagctcctgatctatggtncatcaactttgcgaaggtcgggtccatcaaggttcagcggcagtcggatcgtagggacagaacttcaactctacacaatcagcagcctgcagcctagaactntttgacttaactttattactgtacaaactaccttaatacttacctcttacactttccggcctaagggaacttaaagtgaactagtacaaagttcttgtgactcgcacttntcgttgtc

SEQ ID NO: 330025 - DNA, 587 bp, Homo sapiens
  misc_feature: GZ8MTXP01AWG1A.52.25.C03.1.454.CMB.2.raw
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtagagacagtgtcacatcacttgccggcagtcagggcattagcagttatttagcctggtatcagacaaaaaccgagggaaacncccctaagctcctgatctatggtncatcaactttgacaaggtcgggtacccagtcaaacggttcagcggacagtgggatcgtgggacaagacttcactctcacaatcagcagcctgctagcctagaagtatttgactaacgtttatactgtacctaaactacctttaaagttacttaaccttcctttactaacccgttttccgggaccccttaaggggaaaccccttaaagggttccggaaactaaacttaacgaaaaacggttacctttggcggggtacttcggacccaaccttagtccgtttaagtttcccc

SEQ ID NO: 330026 - DNA, 578 bp, Homo sapiens
  misc_feature: GZ8MTXP01A4PP2.52.25.C03.1.454.CMB.2.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (541)..(541): a, c, t, g, unknown or other
  misc_feature (541)..(541): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctagttattagcctggtancagacaaaaccagggaaacncccctaagctctgatctagtggtgctatctaactttgacgaaggtcgggtacccatcgaaggttcagcggnaggtgatcgtagggacagtaacttcactctacaactaatcaagcacgcctaggcaggtcctagtaagttattttacgacttaaacgtttacttaactcgttaaccaaacttaaccttaagttacgtttaaccttccttctaccgtttccggacccgttaagggaacccttaaagggtcgaactaatacgaaaccgngttaggtcggcttcggcctaccttatccgttcgttcc

SEQ ID NO: 330027 - DNA, 620 bp, Homo sapiens
  misc_feature: GZ8MTXP01D9VTN.52.25.C03.1.454.CMB.2.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctagttattagctggtancaagacaaaacgaggaaacncccctaagctctgatctagtggtanctatcaactttgacgtaagggttcgggacccagtacgtaaacggttccaggcggtacaaggtcgggaatccggtaggggaacctaagggtaaactttccactactacaacatcgagacaacggccctaggcaacggtcctaggaaatattttacgacttaactttattactcgtacaaacttaccttaattaccgttaacttccctttaccgtacgtttcccggcccgttaagggaaacccgaaaggttcggaaacctaattaaccggaaaacgttacgttggccggtaactcgaccctaaccgttacttcgttcgttaacc

SEQ ID NO: 330028 - DNA, 592 bp, Homo sapiens
  misc_feature: GZ8MTXP01B9O9J.52.25.C03.1.454.CMB.2.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (393)..(393): a, c, t, g, unknown or other
  misc_feature (393)..(393): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtnacatccagttgacccagtctccatccttcctgtctgcatctgtaggagacagtntacaccatcacttgccgggcagtcagggcattagcaggtttattagcctggtaanacaagaacaaacgaggaactcctagctactnatctagtgacactatactaacgttcgacggtacggtcgtactagtacgtacggtcaggcgtgaggtagacgtcggaggaactagtactcactactacaacgtacncgacgacgacgacgtacgacgtacgtacgtagtagttacgttactaacttaacgttacttactactaactaacttaacttaacttacttaccttaccttaccttaccgttccgtccgtaacggtaacgttaacgtacgacgtaactaacgttaacgttacgttacgtcgtacgtaacgtactacttactcgttcgttcg

SEQ ID NO: 330029 - DNA, 690 bp, Homo sapiens
  misc_feature: GZ8MTXP01ACVGE.52.25.C03.1.454.CMB.2.raw
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagcgcagtacgacacgaccggtgctcgatttagtagtgtagatttgggtttgggggagtcagtcccagtcaggacacagcatggacatgagggtccccgctcagctccgtggggctcctgctgctctggctcccaggtgccagatgtgacatccagttgacccagtcctccatccttctgtctgcatctgtaggagacagagtcacatcactgccggcagtcgagggcatagctagttattagctgtancagacaaaacgaggaacncccctaagctctgatctagtggtnactactactaacgtttggacgaaggggttccgggtacccaatcgtaaacggttcaggacggtcgaggtcgggattccgtaggggaacctaagtaactttcacttactacacaactacacgacacgaccgtcgacacgtaccgtacgtaacgttaagtttacgttacttaaacgtttaactttaacttacgttaacctaaacctaaaccttaaactttaacgtttaacctttacctttcctttaccgtttacccggttcccgttaaccggtaaaccggttcggttaaaaaaaaaaaaaaaaaaaaaaaaaaaaaaacggttcgtaaacgtaaccgttaaacgttaaacgttacggtaacggtacgtaacgaccgtaccgttacttccgttcgtttccg

SEQ ID NO: 330030 - DNA, 576 bp, Homo sapiens
  misc_feature: GZ8MTXP01DLIRQ.52.25.C03.1.454.CMB.2.raw
  modified_base (255)..(255): a, c, t, g, unknown or other
  misc_feature (255)..(255): n is a, c, g, or t
tcagcgcagtacgacacgaccggtgctcgatttagtagtgtagatttgggtttggggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttgccgggcagtcagggcattagctagttattagcctggtancaagaacaaaaaccgagggaaacgcccctaagcctcctagatctagtggtgactatactaactttgacgtaagggtcgggtaccctagtaccgtaaaggttcaggcggtttcaggtaggatcggtagggaactagtaactcactctacaactatcaagcacgctcgcacgactagtaagtatttagtactaactttacttacttactactaactaacttaattacttaccttaccttcctaccttccgtccgtaacggtaacgttaacgtagacgtactaacaacgacttacgtaagtcgtcgcacttactcgttcgttcc

SEQ ID NO: 330031 - DNA, 607 bp, Homo sapiens
  misc_feature: GZ8MTXP01CYXPC.52.25.C03.1.454.CMB.2.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (444)..(444): a, c, t, g, unknown or other
  misc_feature (444)..(444): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtagganacagatcacatcacttcgccgggcagtcgagggctattagctagttattagcctggtancaagacaaaaacgaggaaacgacccctaagctacctagatctaatggtcacatactaactttgacgtaagggttcgggtaccagtacgtaaacggttcgaggcggtacaggtaggatcgtaggggaactagtaattcactctacaactaaatcgagcacgtccctaggacacgtcctagtaacgttntttacgaaccttaaagtttacttacgtactaacaaaccttaaccttaattactttaccttccttacttaccgttccggtaccgtaacgggtaaccaaacggttacgaactaaactacgaaaacgttacgttgtcggactcgacctacttacttcgttcgttcc

SEQ ID NO: 330032 - DNA, 613 bp, Homo sapiens
  misc_feature: GZ8MTXP01ASKTG.52.25.C03.1.454.CMB.2.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (435)..(435): a, c, t, g, unknown or other
  misc_feature (435)..(435): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcagggcattagctagttattagctggtancagacaaaaccgaggaacncccctaagctctgatctatggtnctatctaactttgacgtaagggtcgggtacccagtaccgtaaggttccgaggtcggactaggtgggaacttcggtaggggaactaaggtaacttccaactctacaacaatcaagcagcctgaccagcctagaaagtttntttacgacttaactttatactacgtaacctaaacttaactttaagttacgtttaccttccttacgtaccgtttccgggacccgttaacgggtaaaccttaaaggtccgaaactaacgtaaccgttaaacggttacgttcgggtcggtaccttcgaccctacgttacttcgttcgttcc

SEQ ID NO: 330033 - DNA, 551 bp, Homo sapiens
  misc_feature: GZ8MTXP01B1Q6R.52.25.C03.1.454.CMB.2.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (408)..(408): a, c, t, g, unknown or other
  misc_feature (408)..(408): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcacatcacttgccgggcagtcagggcattagctagttattagcctggtancagacaaaaccgagggaaacgcccctaagctcctagatctatggtnctatcaactttgacgagggttcgggtcccagtcaacggttcaggcggcaggtcgatcgtaggggacagtaattcactctacacatcagcagcctgcagcctagaagtntttagactaagtttatactagtacctaaactacctttaatacgttacctccttactactttcggccctaagggaacccaaaggtcgaactaacgtacgaaaacgttcttcggtggcctggacccaccttattccgttcgttcc

SEQ ID NO: 330034 - DNA, 543 bp, Homo sapiens
  misc_feature: GZ8MTXP01D69OR.52.25.C03.1.454.CMB.2.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (406)..(406): a, c, t, g, unknown or other
  misc_feature (406)..(406): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcacatcacttgccgggcagtcagggcattagcagttattagcctggtancaagacaaaaaccgagggaaacncccctaagctccngatctatggtncatcaactttgacgaaggtcgggtcccatcgaaggttcaggcggcaggtgatcgtgggacaagtattcactctacacaatcagcagcctagctagcctagaaagtnttttacgacttaaacgtttattactagtaccaaactaaccttaattacttaacctccttctacgtttccggcccgttaagggaaccaaagtcggactatacaaacgacttggtaagctcgctaccattcgttgttcc

SEQ ID NO: 330035 - DNA, 553 bp, Homo sapiens
  misc_feature: GZ8MTXP01EMQLZ.52.25.C03.1.454.CMB.2.raw
  modified_base (254)..(254): a, c, t, g, unknown or other
  misc_feature (254)..(254): n is a, c, g, or t
  modified_base (395)..(395): a, c, t, g, unknown or other
  misc_feature (395)..(395): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttattagctggtancagacaaaacaggaacgcccctaagctctgatctatgtgcatcaactttgcgaaggtcgggtcccatcaaggttcagcgcaggtggatcgtgggacagtaacttcactctacacaatcagcagcctagcagcctagaagtntttagactaaacgtttattactatacaaactaccttaaagttacgttaacctccttctaacctttccgggcccctaaggggaaaccttaaaggtcggaaccaattaaccgaaaaccgttacttggtcggcttaacgccaacccttagttcgttcgtcc

SEQ ID NO: 330036 - DNA, 733 bp, Homo sapiens
  misc_feature: GZ8MTXP01A0ZWK.52.25.C03.1.454.CMB.2.raw
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtcctccatccttcctgtctgcatctgtaggagacagtntcaccatcacttcgccggcagtcgagggcattagctagtttattagctggtancaagaacaaaaacgagggaaacncccctaagcctactagatctagtggtcactatacctaagtttgacggtaacgggttcggtacccagtacgtaacggttcaggcggacgaggtaggatcgtagggaactagtaacttcactctacaaacgtatccgaagccacgtccgtacgaccgtacgtaccgttaaggtaaaacgtttcttttaacgaaaccctttaaacggttttaacgtttaacccgttaacgtaaacccttaaaaccgtttaaacccgttttaaatttaacccggttttaacccctttaccccgtttaacccgtttaaccccggttttcccggggaaccccggttaaacgggggtaaaaccccttaaagggggttcgaaacccttaaacgggtaaacccttaaaaacgggttccgttcggggtaacgtccgttaacaccccgtaattacgttccgtttcgttaaccc

SEQ ID NO: 330037 - DNA, 582 bp, Homo sapiens
  misc_feature: GZ8MTXP01EESOC.52.25.C03.1.454.CMB.2.raw
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (447)..(447): a, c, t, g, unknown or other
  misc_feature (447)..(447): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtcctccattccttcctgtctgcatctgtaggagacagtgtcaccatcacttcggccgggcagtcagggcattagctagttattagctggtancagaacaaaacgaggaacncccctaagctctagatactagtggtanacattactaactttgacgtaagggttcgggtacccagtacgtaacggttcgaggcggacgtagggtacggaattcggagggaacctaagtaacttccactctacaacgaatcgaagcacgccctaggaccagtcctagtaatntttacacttaaactttattactactactaactaacgtttattacttaccttccttctacgtttccggccctaagggtaaccagtacgactaagtaaccaacgttnttcggtgcncgtcacttcttccgttgttcc

SEQ ID NO: 330038 - DNA, 586 bp, Homo sapiens
  misc_feature: GZ8MTXP01AKW32.52.25.C03.1.454.CMB.2.raw
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
tcagcgcagtacgacacgaccggtgctcgatttagtagtgtagatttgggtttggggagtcagtccagtcaggacacagcatggacatgagggtcccgctcagctcctggggctcctgctgctctggctcccaggtgccagatgtgacatccagttgacccagtctccatccttctgtctgcatctgtaggagacagagtcaccatcacttggccggcagtcagggcattagcagttattaggctgtatcagacaaaaccgnggaagccctaagctacngatctanggtgacatacaactttgacgaaggtcgggtaccagtcaacggttcaggtcgacagtaggatcgtgggacagattcactctcaanatcagactacgctacgacacgtactagaagttactttacgtaaccttaaacgtttacgttacgttacgtaacctaaaccttaaccttaaggttacctttaccttccctttaccggtaccgtttccggacccggttaagggaaaccttaaggtacgaactaacgtaaccttaaacggttcgttcggtccgtctaacgtaccctacttctcgttcgtc

SEQ ID NO: 330039 - DNA, 685 bp, Homo sapiens
  misc_feature: GZ8MTXP01BLN1M.52.25.C03.1.454.CMB.2.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcacatcacttggccgggccagtcagggcattagcagttattagctggtancaagacaaaacgagggaaacncccctaagctcctgatctatggtgcatctaactttgacgtaagggtcgggtaccagtacgtaaacggttcaaggcggacgtaggtacgggtacttcggtaggggtaaccaaaggtaactttccaacttctacaacctaaatcccaaaggcccaacgtccctagggacctacggtacccgtaagtaaaaccgttatttttacggaaacctttaaaccgttttatttaaacccgttacgttaaacccttaaaacctttaaccgtttaaactttacccgtttacccttacccgtttaccgttacccgtttcccgggaacccgttaacgggtaaaccgttaaaggtacgaacgtaaacgtaaccgaaacgttcgttcggtaacgcctaacgaccctacgttcttcgttcgtaac

SEQ ID NO: 330040 - DNA, 528 bp, Homo sapiens
  misc_feature: GZ8MTXP01ASSG0.52.25.C03.1.454.CMB.2.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (500)..(500): a, c, t, g, unknown or other
  misc_feature (500)..(500): n is a, c, g, or t
  modified_base (525)..(525): a, c, t, g, unknown or other
  misc_feature (525)..(525): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggcagtcagggcattagctagttattagctggtancaagacaaaaacgagggtaaacncccctaagctcngatctatggtncatctaactttgcgtaaggtcgggtaccagtcgaaggttcagcggcagtgatcgtaggacagtaacttcactctacacaagtcaagcagcctgacagccagaagtatttgaccttaagttattactagtactaactacttaatacgttctaccttcgtacttcgacccgtaaggaccaaggtcgacagtaacaacgttnttgtaacgctgccacttagtcgttntcc

SEQ ID NO: 330041 - DNA, 648 bp, Homo sapiens
  misc_feature: GZ8MTXP01B4E49.52.25.C03.1.454.CMB.2.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcagggcattagctagttattagcctggtancaagacaaaaacgaggaaacncccctaagctcctgatctatggtnactatctaaactttgacgtaaggtcgggtacccagtacgaaaggttcaggcggactaggtaggaacttcggtagggaactaagtaacttcaacttctacaactaatcgaagcaacgccctaggacctaacgtccgttaagaaacgttattttagaacccttaaaagttttactttaaccgtactaacctaaaacttaccgtttaaactacgttttaacctccctttaacgtacccgttttccggccctttaaggggaaaccttaaagggtcgaaacctaaattaaccgaaaaaccggttgttcggtaacgtaccgttaacgaccgtaacttacgttccgtttcgttaacc

SEQ ID NO: 330042 - DNA, 615 bp, Homo sapiens
  misc_feature: GZ8MTXP01AO851.52.25.C03.1.454.CMB.2.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtntcaccatcacttgccggcagtcagggcattagctagttattagcctggtancaagacaaaaaccgngggaaacncccctaagcctcctgatctagtggtgcatctaacgttttggaccgtaaagggggttcgggtacccagtacgaaacggttcaggccgggactaggtcgggaattcggtaggggaactaaggtaactttccaacttctaccaactaaactcaaggcacgccctaggaccagtccgtagaaacgtattttacgacttaacgttattactagtacctaaaccttactttaagttacgtttaccttccttctaccgtttccggcccttaagggaacccttaaaggtcgaactaacgtaacaaacgttacttggtcgctcgacctaccttatccgttgttaacc

SEQ ID NO: 330043 - DNA, 594 bp, Homo sapiens
  misc_feature: GZ8MTXP01B1V4I.52.25.C03.1.454.CMB.2.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (573)..(573): a, c, t, g, unknown or other
  misc_feature (573)..(573): n is a, c, g, or t
  modified_base (583)..(583): a, c, t, g, unknown or other
  misc_feature (583)..(583): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcacatcacgttcggccgggcagtcagggctattagctagttattagctggtancagacaaaacgaggaacnccctaagctactgatcgtagtggtnactatactaacgtttggacgtaagggtcgggtacccagtaccgaaggttccaggcggtacgaggtggactcggaggggaactaaggtacttccgactctacaactagtcagcacgcctacgacacgtaccgtagtaaagttactttagtaacctttaaacgggtttacttacgtactaaacctaacctttaaacttattacctttaccttcttacgtaccgttccgaacgtaagaaacttaggacactaacggaaccttaagcgttgcgtacncgtaaccctnttctcgttctc

SEQ ID NO: 330044 - DNA, 301 bp, Homo sapiens
  misc_feature: GZ8MTXP01EZABR.52.25.C03.1.454.CMB.2.raw
tcagcgcagtacgacacgaccggtgctcgatttagtagtgtagatttgggtttggggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcaccatcacttgccggccagtcagggcaagttagtacgtagtttagtttacgtaccgtaggtatacaacgaacgaaaaccgaaacggaaacgacctacc

SEQ ID NO: 330045 - DNA, 691 bp, Homo sapiens
  misc_feature: GZ8MTXP01DOMBR.52.25.C03.1.454.CMB.2.raw
  modified_base (288)..(288): a, c, t, g, unknown or other
  misc_feature (288)..(288): n is a, c, g, or t
tcagcgcagtacgacacgaccggtgctcgatttagtagtgtagatttgggtttggggggagtcagtcccagtcaggacacagcatggacatgagggtccccgctcggctcctggggctcctgctgctctggctcccaggtgccagatgtgacatccagttcgacccagtctccatccctttcctgtctgctatctggtaggagacagagtcaccatcacgttcggccggcagtcgagggctattagctagttattagctggtatacgaagaacaaaacgaggaaaccncccgtaagcctctgatctagtggtcactatactaacgtttgacggtaagggtcggtaccagtacgtaggtcgacggcgacgtaggtaggaaacgtcggtaagggaactaacggtaaacttcctaactacctacaaactaactcgacgacgaccgtctacggacacggtacctaagttaaacgttacgttttaacgactttaaacgtttacgtaccttaactaaaccttaaaccttaacgtttaactttaaccgttacctttacccttaccgttaacccggttccggtaaccccggtagggtaaaaccctaagggttacgaaaccttaaactaaaccggtaaaacgttcgttcggttacggtcctacgaacctaccgttacttccttaacgtttaacccttccg

SEQ ID NO: 330046 - DNA, 818 bp, Homo sapiens
  misc_feature: GZ8MTXP01CJWM0.52.25.C03.1.454.CMB.2.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
tcagcgcagtacgacacgaccggtgctcgatttagtagtgtagatttggggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtagganacagtgtcaccatcacgttcgccggcagtcagggcattagctagttattagctggtancaagaacaaaacgaggaacnccctaagctctgatctagtggtcgactactactaacgtttggacgtagggttcgggtccaagtacgtaaacggttcgaggtacggcgtaggttacgggaacgttcggtacggggtaaacctaaagggttaacttacctaaacgttacccttaacaaacccgtaaattaccgaaaccgggtccaaacggttccccgttaaggacccgtaaaccgggtacccgtttaaaggggttaaaactttacgtttttaaccgaaacctttttaaaaccggttttaaacgttttaacctttaacggttaaacccttaaaaacccgtttaaccccgtttttaaaatttaacccggtttttacccctttaacccgttttaacccgttaaacccggggtttttccccggggaaccccggtttaaacgggggtaaacccgttaaaaagggttaccggttaaacctaaacggtttaaacccgaaaaacggttccggttcgggttaacgccggttaacgaaccctaccgtttaacttccggttcccgtttttaacc

SEQ ID NO: 330047 - DNA, 794 bp, Homo sapiens
  misc_feature: GZ8MTXP01AHVEA.52.25.C03.1.454.CMB.2.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcacatcacttgccgggcagtcgagggcattagctagtttatttagcctggtatcaagacaaaacgaggaacncccctaagctcctgatctagtggtnacatctaactttggacgtaaggggttcggggtacccaagtcgtaaacgggttcgaaggtccggggactagggttaacgggaagtttcccgggtagggggtaaaccctaaagggttaaaaccttttccaacccgtttaccttaacccggaaacttaaaacttccgaacgggtaccaaccggtccgttacggtaccgaacggtaccccgttaagggttaaaacggtttattttttaccggaactttaaaaccgttttaatttacccggttagttaaacccctaaaaccctttaaaccttttaaaacggtttaaccgtttttaaaccccttttccgttttaaacccgtaccggttttttacccccggggccccggtttaaacgggggaaaacccttaaagggtaccgggttaaacctaaacgtaacccggttaaaaccgttaacgttgggtaacgggtacttaacgaccctaccttagtttcccgttcgtttaaccc

SEQ ID NO: 330048 - DNA, 554 bp, Homo sapiens
  misc_feature: GZ8MTXP01BRY3I.52.25.C03.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (388)..(388): a, c, t, g, unknown or other
  misc_feature (388)..(388): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatgcagttgacccagtctccatccttcctgtctgcatctgtaggagacagagtcaccatcacttgccggcagtcagggcattagcagttattagcctgatcagcaaaaaccngggaaancccctaaagcncctgatctatggtgcatcaaactttgcaaggtgggtcccatccaaaggttcagcggcaagtggaatctaggggacagaattcaactctcacaaatacaagacacgcncgcacgactagtaagtatttagtacgtaacttaacttaacttacgtactaactaacttaaacttaacttacttaccttactacgttccgtccgtacggacgtaaacgttaacgtaacgaacttaacgaaacgaaacgtaagtcgtcgtcgtacactaacttcgtcg

SEQ ID NO: 330049 - DNA, 638 bp, Homo sapiens
  misc_feature: GZ8MTXP01D0RYK.52.25.C03.1.454.CMB.2.raw
  modified_base (258)..(258): a, c, t, g, unknown or other
  misc_feature (258)..(258): n is a, c, g, or t
  modified_base (625)..(625): a, c, t, g, unknown or other
  misc_feature (625)..(625): n is a, c, g, or t
tcagcgcagtacgacacgaccggtgctcgatttagtagtgtagatttggggtttgggggagtcagtcccagtcaggacacagcatggacatgagggtccccgctcagctcctggggctcctgctgctctggctcccaggtgccagatgtgacatccagttcgacccagtcctccatccttcctgtctgcatctgtagagacagatcacatcacttggccggcagtcgagggctattagctagtttattacgctggtancaagacaaaaccgagggaacgcccctaagctctagatctagtcggtgactatactaacgtttggaccgtaagggggttccggggtacccaagttaccggtaaacgggttccgaacgggcggtacgtagggttaacggacgttccggtaggggaaaccctaaaggtactttaccacttactacaaacctatccaagccacgtcctacggctacgtcctagtaagttattttacaacctttaatttcttaacgtactacctaaacttacttaatttacttaccttccgttctaccgttccggacccgtaaggtaaaccgttaagtcgttaactacgtaacaaacgttcgttggcgtactcgccaacttntcgttaagttccc

SEQ ID NO: 330050 - DNA, 766 bp, Homo sapiens
  misc_feature: GZ8MTXP01CJPHR.52.25.C03.1.454.CMB.2.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagtgtcaccatctacgttcggccgggccagtcgagggctaagttagctagttattagccgtaggtanacgaagaaccaaaaacgaggaaacncccctaaagctacctgatctagtggtanacattactaaacgtttggacgtaaggggttccgggtacctaagtacgtaaacgggttcgacggcggtacgtaaggtcggtaacgtcggtacggggaaactaagttaaactttccaacttacctacaaacctaatacgaacgcgaacgtccgttacggactacgtaccgtagtaaacgttaacgttttacgaacctttaaacgtttactttaaccgttaacgttaaacccttaaacttaaacccgttttaaacgttaaccgttttttaaccccttaccccttttaaccgtttaccccggttttaccgggtacccccggttaaacggggtaaaaccccttaaagggggttaccgttaaacccgttaaacgtaacccggttaaaaacggttccgttaagggtcccggtactaaccggtacctaccgttactttcggttcgttttaaccc

SEQ ID NO: 330051 - DNA, 677 bp, Homo sapiens
  misc_feature: GZ8MTXP01E1FC9.52.25.C03.1.454.CMB.2.raw
  modified_base (323)..(323): a, c, t, g, unknown or other
  misc_feature (323)..(323): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacgttcggccgggccagtcgagggcattagctagttatttacgccttaggtatacgaacgaaccgaaaaaaccgagggaaacgaccccctaagcctacctgatctagtggtnactatactaactttgacgtaagggtcgggtacccagtacgaacggttcgaggcggacgaggtaggatcgtagggacaagtatcactctacacaatcacgacacgtcctacggactacgtaccgttaagtaacgttagtttacgaaacttaacgtttaagtttaaccgtaacgttaaccctaaaacttaaaccggtttaaacttaccggtttaaccctttccctttaaccgttacccggttttacccgggaccggtaacggggtaaaccttaaacgggcggttaaactaaaccgtaaacgttaaaacccgttagttcggaacgtctaacgacctacttacttccgttcgttaacc

SEQ ID NO: 330052 - DNA, 735 bp, Homo sapiens
  misc_feature: GZ8MTXP01AT52T.52.25.C03.1.454.CMB.2.raw
  modified_base (288)..(288): a, c, t, g, unknown or other
  misc_feature (288)..(288): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtcctccatccttcctgtctgcatcgtgtaggagacagatcacatcacgttgccggcagtcgaggtctagttagctagtttattacgccgtaggtatacaagaaccaaaaacgagggaaacnccccgtaaagctacctgtactctagtggtcgactagttactaacgttttgaccggtaagggttccgggtaccctaagttaccggtaaacggttcgacggccgggtactagggttaacgggacgttcggacggggaaactaggtaaactttccaacttcctacgaaaccttaaactacacggacaccggtaccgtacgactacgtaccgtaagttaacgttacgtttaacgtaaccgttaaacgtttaacgttaacgttaaccgttaaccttaaaccttaacgtttaacgtttaccgtttacccttacccgtttaccgttaccggttttcccggaacccggtaacgggtaaaccgttaaacgggtaccgttaaacctaaacggtaaccgttaaacggttcgttacggtaacgcttaacgaccctacttacgttccgttaacgttaacc

SEQ ID NO: 330053 - DNA, 559 bp, Homo sapiens
  misc_feature: GZ8MTXP01D06J4.52.25.C03.1.454.CMB.2.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagagtcacatcacttgccggcagtcaggcattagctagttattagctggtancagacaaaacgaggaacnccctaagctctagatctatggtnctatactaacgtttgacgtaaggggtcgggtaccagttacgtaacggttcaggccggntaggtacgggatcggagggaactaagtaacttccactctacaacatcgagcagcctgacncgtcagtaattnttacgacttaacgttacttactacgtactaacgtaccttaagtactttacctcttcgtactttccggacgttaacggaaccttaagggcaacaacgtacaaacgttcngtaacgcncgaccacacgttcttcgttc

SEQ ID NO: 330054 - DNA, 732 bp, Homo sapiens
  misc_feature: GZ8MTXP01AYK7B.52.25.C03.1.454.CMB.2.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (437)..(437): a, c, t, g, unknown or other
  misc_feature (437)..(437): n is a, c, g, or t
  modified_base (692)..(692): a, c, t, g, unknown or other
  misc_feature (692)..(692): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccgaggtgccagatgtgacatccagttcgacccagtctccatccttcctgtctgcatctgtaganacngtctcacatctacttgcccgggcagtcagggtctagttagctagtttagttacgcctaggtanacgaagaaccaaaacggagggtaaaccncccctaaaggccttaccngtacgtctagtcggtcgactacttaccgtaacgtttcggacgtaaggggttcggtacccctagtacgtaaccggttcgaagggtcccggtgaggtgtaccgtgtagggaacctaggtacttacacttnaacactactcgaacgtcgaacgcgtaagccgaacgtccgtaagtaaacgtttcgttaacgtaccgttaaacgtttacttaacggttacctaaaccgttaaacccttaaccggtttaaaatttcccgtttaaacccttcccgttacgtttaaaccccggttttcccggaaccggttaaacgggtaaacgttaaaccggggtcgttaaaccgtaacctaaacggggttaaaaccttccgggttagtcccggttaccncggtaaacctacccgggtttactttccgttcgttaacccg

SEQ ID NO: 330055 - DNA, 593 bp, Homo sapiens
  misc_feature: GZ8MTXP01B25QV.52.25.C03.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
  modified_base (583)..(583): a, c, t, g, unknown or other
  misc_feature (583)..(583): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcaccatcacttgccgggcagtcagggcattagctagtttattagcctggtancagacaaaacgagggaacncccctaagctcctgatctatggtncatactaactttgacgtaggtcgggtaccagtcgaaggttcaggcggnaggtagatcgtagggactagtaacttcactctacactaatcagcagccctaggacctaggcctaggtaacgttnttttacgacctttaaacgtttacttacgtacgtacctaaaaccgtcctttaaagttacgtttaccctccgtttacgtaaccgttttccgggaacccgttaaggggtaaccttaaaggttcgaactaacgttaacaaacgttgttcgaaggctcgacaccttntccgttgtcc

SEQ ID NO: 330056 - DNA, 545 bp, Homo sapiens
  misc_feature: GZ8MTXP01BIW00.52.25.C03.1.454.CMB.2.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtgacatccagttgacccagtctccatccttcctgtctgcatctgtagganacagtgtcacatcacttgccggcagtcagggcattagctagttattagctggtancaagacaaaaacgagggaaacncccctaaagctacctgacttctagtggtgactattacgaaactttgacgtaagggtcggtaccagtcaaggttcagcgganagtggatcgagggaacagtaactcactctcaacaatccagctacgctagctagccgtagaaacgtttnttacgacttaactttatactatacctaaactacttaatacttacctcttctacgtccgacgtaaggtaacagtacataactaacacgttacgttggtcgatcgactacttattccgttaagtc

SEQ ID NO: 330057 - DNA, 751 bp, Homo sapiens
  misc_feature: GZ8MTXP01DSG07.52.25.C03.1.454.CMB.2.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagcgcagtacgacacgaccggtgctcgatttagtagtgtagatttgggtttggggggagtcagtcccagtcaggacacagcatggacatgagggtccccgctcagctcctggggctcctgctgctctggctcccaggtgccagatgtgacatccagttgacccagtcctccattccttcctgtctgcatctggtaggagacagagtcacatcacttcggccggccagtcgagggcattagcagttattagcctggtancaagacaaaacgaggaaacnccctaagctctgatctagtggtnactatactaacgtttgacgtaggtcgggtacccagtcgtaaacggttcaggcgtacgtaggtcggtatccgggtagggaactaaggtaactttcccaacttctaaccaactaacgtaccgaacgacaacggtcccgttacgaaccgtacggtaccccgttaaggtaaaaggtttactttttacggtaaaccctttaaaacgttttaccttttaaaccggttaacgtttaaaccctaaaaccctttaaacccgtttttaaaccgttaaacgttttttacccccttaccgtttttacccgttaaccccgttttaccccggggaccccggttaaacggggtaaacccgttaaacgggttaaacggttaaactaaaccgttaaccgttaaaaacggttcgttacgggtccggtactaaccggtaactaccttactttcgttaaccgtttccc

SEQ ID NO: 330058 - DNA, 547 bp, Homo sapiens
  misc_feature: GZ8MTXP01BQOK7.52.25.C03.1.454.CMB.2.raw
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagtgtcaccatcacgttgccgggccagtcagggctattagctagttatttagcctggtatcagaacaaaaccgaagggaacgacccctaagcctctagatctatggtnactatactaactttgacgtaggtcgggtacccagtcgtaacggttnaggtcggcagtcggactcgtagggacagtaacttcgactntacacaatcagctagcctgacngacctagaatnttagacttaacgttatacgtntacaactacttaattcgttactccttactcgttccggctaaggtaacaaggtgaacataacaacgacgttgngtacncgtacacgttatcgttcttaac

SEQ ID NO: 330059 - DNA, 496 bp, Homo sapiens
  misc_feature: GZ8MTXP02JUR8S.52.25.C03.1.454.CMB.2.raw
  modified_base (297)..(297): a, c, t, g, unknown or other
  misc_feature (297)..(297): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagcagttattagcctggtatcagacaaaaaccagggaaagcccctaagctcctgatctatggtncatcaactttgcaaggtgggtccatcaaggttcagcggcagtggatctgggacagaattcactctcacaatcagcagcctgcagcctagaagtattttgactaaacttattactgtacaaactaccttaatagttactcttcactttcgccctgggaccaaaggtcgacagtacaaacgactgtggctgcacatctgtc

SEQ ID NO: 330060 - DNA, 540 bp, Homo sapiens
  misc_feature: GZ8MTXP02ISGNB.52.25.C03.1.454.CMB.2.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctagttattagcctggtatcagacaaaaaccgagggaaacncccctaagcctctgatctatggtnctatctaactttgacgtaaagggtcggggtccccaagttccgaaagggtttcaaggcggactaggtggatcgtaggggaacagtaaacttccaactctacaacatcagcagcctgcagctagatntttgacttatattcntacaactacttatacgttactcttctacgttcgcctacggacctaaaggtcgaaactataccgaaaacgtcgtagtcgctagaccactactcgtcttc

SEQ ID NO: 330061 - DNA, 517 bp, Homo sapiens
  misc_feature: GZ8MTXP02IXEHF.52.25.C03.1.454.CMB.2.raw
  modified_base (248)..(249): a, c, t, g, unknown or other
  misc_feature (248)..(249): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (283)..(284): a, c, t, g, unknown or other
  misc_feature (283)..(284): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
tcagcgcagtacgacacgaccggtgctcgatttagtagtgtagatttgggtttggggagtcagtccagtcaggacacagcatggacatgagggtcccgctcagctcctggggctcctgctgctctggctcccaggtgccagatgtgacatccagttgacccagtctccatccttcctgtctgcatctgtaggagacagtgtcaccatcacttgccggcagtcagggcattagcagttattgctggtannanacaaacgaggaacncctanctcnntntatgtnnatactacttgacgaggtcggtcatctacgtcgagcgcagtgatgtggacagatactactctacacatananacacncncgcacgacgtagtagtattagtactaacttacttactactactaactaacttaacttacttacttacttacttacgttcgtaccgtacggtacgtaaacgtacgtactaactactaaacgtaacgtacgtgtacgtacgactactactactactc

SEQ ID NO: 330062 - DNA, 490 bp, Homo sapiens
  misc_feature: GZ8MTXP02FVZPL.52.25.C03.1.454.CMB.2.raw
  modified_base (488)..(488): a, c, t, g, unknown or other
  misc_feature (488)..(488): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggccagtcagggcattagcagttattagcctggtatcagcaaaaaccaggaaagcccctaagctcctgatctatggtgcatcaactttgcaaggtgggtccatcaaggttcagcggcagtggatctgggacagaattcactctcacaatcagcagcctgcagcctgaagattttgctaacttattactgtacaaactaccttaatacgttactccttcactttcggccctaggaccaaagtggacatcaaacgactgtgctgcacatctntc

SEQ ID NO: 330063 - DNA, 574 bp, Homo sapiens
  misc_feature: GZ8MTXP02G6OQY.52.25.C03.1.454.CMB.2.raw
  modified_base (302)..(302): a, c, t, g, unknown or other
  misc_feature (302)..(302): n is a, c, g, or t
  modified_base (432)..(432): a, c, t, g, unknown or other
  misc_feature (432)..(432): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttattagcctggtatcaagacaaaaacgagggaaacgcccctaagcctcctgatctatggtncatcaaactttgacgtaaggggtcggggtacccagtaccaaaggtttccaaggccggacaggttggatcgtgggaacaagtaacttcaactctacaacaatccaagcagccctgccagcctagaaagttntttacgacttaaacttattactagtaacctaaacttaacttaaattacttaccttcttactacgttccgaccgtacgggaactaaaggtcgaacaactaacgaaaacgtacgtaggcgtcgtacgactactacttcgtactc

SEQ ID NO: 330064 - DNA, 509 bp, Homo sapiens
  misc_feature: GZ8MTXP02HVDGK.52.25.C03.1.454.CMB.2.raw
  modified_base (507)..(507): a, c, t, g, unknown or other
  misc_feature (507)..(507): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagacaaaaaccaggaaacgcccctaaagctcctgatctatggtgcatcaactttgcaaaggtggggtcccatcaaggttcagcgcagtggatcgtgggacagaattcactctcacaatcagcagcctgcagcctgaagattttgactaaactttattactgtacaaactaccttaagtacttactcttcactttcggcccttgggaacctaaagtcgacatacaaaacgactgtggctgacacctatcttntc

SEQ ID NO: 330065 - DNA, 513 bp, Homo sapiens
  misc_feature: GZ8MTXP02HJN68.52.25.C03.1.454.CMB.2.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (511)..(511): a, c, t, g, unknown or other
  misc_feature (511)..(511): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgcccagatgtgacatccagttgacccagtctccatccttcctgtctgcatctgtaggagacagagtcaccatcacttgccgggccagtcagggcattagcagttattagcctggtatcagcaaaaaccnggaaancccctaagctcctgatctatggtncatcaatttgcaaaggtcggggtcccatcaaggttcagcggcagtgatcgtgggacagaattcactctcacaatcagcagcctgccagcctgaaagtnttttagcttaaacttatttactntacaaactaccttaaatactttaactccttctactttcggccctagggaccaaagtcgaacactacaaaacgactgtaagctcgcacatctntc

SEQ ID NO: 330066 - DNA, 535 bp, Homo sapiens
  misc_feature: GZ8MTXP02GSF75.52.25.C03.1.454.CMB.2.raw
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (513)..(513): a, c, t, g, unknown or other
  misc_feature (513)..(513): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagctagttattagcctggtatcagacaaaaaccagggaaacncccctaagcctcctgattctagtggtgcatactaactttgacgtaaagggtcggggtacccagttacaaggttcagcggcaggtggatcgtagggactagaattccatctacaanaatcagcagcctgcctagctaggaattatttcgattaaacttnttacntaccaaactaccttaaatacgttactccttatacgtttcgcctaggacctaaagtcgaacacgtacaaaacgtntgaacgcacgacactntctntc

SEQ ID NO: 330067 - DNA, 592 bp, Homo sapiens
  misc_feature: GZ8MTXP02FIPBA.52.25.C03.1.454.CMB.2.raw
  modified_base (278)..(278): a, c, t, g, unknown or other
  misc_feature (278)..(278): n is a, c, g, or t
  modified_base (358)..(358): a, c, t, g, unknown or other
  misc_feature (358)..(358): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggccagtcagggcattagcagttatttagcctggtatcagacaaaaaaccagggaaacncccctaagctcctgatctatggtgcatcaaactttgacgtaaggtcggggccagtcaacggttcagcggcagtggatcgngggacagaatcactctcaacatcagcagcctgcagcctagaaagtattttagactaaactttattacgtagttaccaaactaaccctttaaagttactttaacccttcctttactaaccgtttttccgggaccccttagggggtaaacccctaaagggttcggaaacctaacgtaaccgaaaacgtaacttggtaacggtacctacggacctaacccgtattccgttacgttcc

SEQ ID NO: 330068 - DNA, 556 bp, Homo sapiens
  misc_feature: GZ8MTXP02FN8FG.52.25.C03.1.454.CMB.2.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcagggcattagcagttattagcctggtatcagacaaaaaccnggaaacncccctaagctcctgatctatggtncatcaactttgctaaagggtcggggtacccaagtcgaaacgggtttcaaggcgggacaggttggaatccgtaggggactaagtaattcaactctacaacaatcagcagcctagcagcctagaagtatttgactaattattacgtntaccaaactaccttaatacgttactccttacgacttttcggaccccttgggaaccctaaaaggttcgaactaactaccgaaaacgacttggcgactagaccacatctattccc

SEQ ID NO: 330069 - DNA, 597 bp, Homo sapiens
  misc_feature: GZ8MTXP02J0ISP.52.25.C03.1.454.CMB.2.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagctagttattagcctggtatcagacaaaaaccgagggaaacncccctaagcctcctgatctagtggtncatcctaaactttggacaaaggggttcggggtaccccagttaccgaaacgggttcaggccgggactaggttgggaatccggtagggggaacaaggtaattccaacttctacaactaaactcaagcagtccctgccagtccctagaaacgtattttgacttaaatttattacgtagtaccaaacttacttaaattacgttaccttccttctacgtttccggcccttaggggaacccaaaggtcggaaactacgtacaaaacgtatcggaagctacgacctaccattccgtacttcc

SEQ ID NO: 330070 - DNA, 572 bp, Homo sapiens
  misc_feature: GZ8MTXP02ID3IE.52.25.C03.1.454.CMB.2.raw
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagcagttattagcctggtatcagacaaaaccgaggaaacncccctaagcctcctgatctatggtnctatcaactttgactaagggtggggtcccatcgaaggttcagcgcagtggatcgtgggacagtaattcactctacacatcagcagccctgcagcctagaacgtattttgaccttaaactttatttaaccgtgtaccaaacctacctttaaatacgttttacctacctttctaaccgtttccggccccttaaggggaaccctaaaggttcggaacctaatacccgaaaaacgtaccgttggcggtcttacgacctaccactttccgtacgtttcc

SEQ ID NO: 330071 - DNA, 536 bp, Homo sapiens
  misc_feature: GZ8MTXP02HZTRO.52.25.C03.1.454.CMB.2.raw
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagatcaccatcacttgccgggcagtcagggcattagctagttattagctggtatcagacaaaaaccngggaaaccccctaagctacctgatctatggtnctatcaactttgacaaggtcgggtccatcaaggtcagcgcagtgatcgtggganagtattcactctcacaatcagcagcctgcagctagatntttgactatttattactgtacaactacttaatacgtttacctttactacgtttccgcccgtagggtaaccaaagttcggaacctaaagttaccgaaaaacgttacttggaacggttacctacgacctaccgtacttccgttacgtc

SEQ ID NO: 330072 - DNA, 528 bp, Homo sapiens
  misc_feature: GZ8MTXP02JNDNU.52.25.C03.1.454.CMB.2.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
tcagcgcagtacgacacgaccggtgctcgatttagtagtgtagatttgggtttgggggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcaccatcacttgccgggccagtcagggcattagcagttattagcctggtatcagcaaaaaccaggaaacncccctaagctctgatctatggtncatcaactttgcaagggtggggtacccagtcaacggttcagcgcaggtggatcgtgggacagtaatcactctcacatcagcagcctgccagcctagaagtatttagctaaactttattaacctgtacaaactacctttaaatcttactcttacctacgtttcgacccttaggggacctaaaggtcggacaacttacaaacggtaatgtaacggactcgacaccatcttctac

SEQ ID NO: 330073 - DNA, 601 bp, Homo sapiens
  misc_feature: GZ8MTXP02HEDU2.52.25.C03.1.454.CMB.2.raw
  modified_base (275)..(275): a, c, t, g, unknown or other
  misc_feature (275)..(275): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagtgtcaccatcacttgccgggcagtcagggcattagctagttattagcctgtatcagacaaaaacgaggaaacncccctaagcctctgatctatggtgctatcaactttgacgtaagggtcggggtcccaagtcgaaacggttcagcggactaggtggaatcggtaggggaactaagtaaatttccaacttctaacaacctaaatcgaagccaagccctgaccaggtacctaagtaagttattttacgacttaaactttatttactgttaaccaaaacttacctttaaatacgtttactcccttactaccgtttccggacccttagggaaaaccctaaaggtcgaaactaactaccgaaaacgtacgtggaacgtctacgacctaacctcttactcgtcc

SEQ ID NO: 330074 - DNA, 528 bp, Homo sapiens
  misc_feature: GZ8MTXP02GPDXL.52.25.C03.1.454.CMB.2.raw
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagcgcagtacgacacgaccggtgctcgatttagtagtgtagatttgggtttgggggagtcagtcccagtcaggacacagcatggacatgagggtccccgctcggctcctggggctcctgctgctctggctcccaggtgccagatgtgacatccagttgacccagtctccatccttcctgtctgcatctgtaggagacagagtcaccatcacttgccgggccagtcagggcattagctagttattagctgtatcagacaaaacgaggaaacncccctaagctcctgatctatggtncatctaactttgacgtaagggtcgggtcccaagtcgaaaggttccaggcggacaggtggatcgtggggacaagtaacttccactctacactaatcagcagcctgcagctagaatatttgactaacttntactntacaactactaatacgttactctactacgtttcgccgtaggaaccaaagtgaactactaacaaacgactggtacgctacgacacctatcgtctcttac

SEQ ID NO: 330075 - DNA, 519 bp, Homo sapiens
  misc_feature: GZ8MTXP02I6I4B.52.25.C03.1.454.CMB.2.raw
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (359)..(359): a, c, t, g, unknown or other
  misc_feature (359)..(359): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctccaggtgccagatgtgacatccagttgacccagtctccatccttcctgtctgcatctgtaggagacagtgtcaccatcgacttgccgggcagtcagggcattagcagttattagcctggtatcagcaaaaaccnggaaacncccctaagctctgatctatgtgcatcaactttgcaaggtgggtcccatcaaggttcagcgcagtgatcgtgggacagattcatctanacatcagcagctgcagcctgaagattttgactaacttattactgttacaaactaccttaaatacgttacctaccttcgaactttcggacccttaggggaccctaaaaggttcggaaacacgtacaaaaacgctagtggccctgctacacttctacgttcc

SEQ ID NO: 330076 - DNA, 583 bp, Homo sapiens
  misc_feature: GZ8MTXP02JQOX7.52.25.C03.1.454.CMB.2.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagcagttattagcctggtatcagacaaaaaaccgngggaaacgcccctaagcctacctgatctatggtnctatctaaactttgacgtaaagggtcggggtacccagtcgaaacggttcaggcggcagtggatcgtgggaacagtaattcactctacaacaatcagcagcctagcagtcctagaagtattttcgacttaaattattacgtntacaaactacctttaatagtttacctccttactaccgtttccggacccgttagggaaacctaaaggtcggaaactacgttaaccgaaaaccgtacgttaggcggtactacggaccctaaccgtattcccgtttacttcc

SEQ ID NO: 330077 - DNA, 525 bp, Homo sapiens
  misc_feature: GZ8MTXP02FUSOY.52.25.C03.1.454.CMB.2.raw
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggccagtcagggcattagcagttattagcctggtatcagcaaaaaccngggaaancccctaagctcctgatctanggtgcatcaactttgcaaggtgggtccatcaaggttcagcggcagtggatcngggacagaattcactctcacaatcagcagccctgcagcctgaacgtattttgctaaacttattaacctgttacaaactaccctttaaataggttacctccttcaccttttcgggaccccttggggacccaaaaggttcggaacataccaaaacgaactgtggctggcaccatcctgttcc

SEQ ID NO: 330078 - DNA, 531 bp, Homo sapiens
  misc_feature: GZ8MTXP02I897A.52.25.C03.1.454.CMB.2.raw
  modified_base (279)..(279): a, c, t, g, unknown or other
  misc_feature (279)..(279): n is a, c, g, or t
  modified_base (416)..(416): a, c, t, g, unknown or other
  misc_feature (416)..(416): n is a, c, g, or t
  modified_base (502)..(502): a, c, t, g, unknown or other
  misc_feature (502)..(502): n is a, c, g, or t
tcagcgcagtacgacacgaccggtgctcgatttagtagtgtagatttggggtttgggggagtcagtcccagtcaggacacagcatggacatgagggtccccgctcagctcctggggctcctgctgctctggctcccaggtgccagatgtgacatccagttgacccagtctccatccttctgtctgcatctgtaggagacagtgtcaccatcacttggcccgggcagtcagggcattagctagttattagcctggtatcagacaaaaaccgagggaaacncccctaagcctcctgatctagtggtgcatactaacgtttgacgtaagggtcgggtacccagtacaacggttcagcgagaggtggatcgtagggacagtaacttcactctacaacatcagcagcctgcagctagagtntttagactattatactgtacaactaccttaatacgttactcttactacttcgccgtacggaacaagtcgaactactacgaaacgtntgaacgctagacctaactctacgtcttac

SEQ ID NO: 330079 - DNA, 599 bp, Homo sapiens
  misc_feature: GZ8MTXP02H402S.52.25.C03.1.454.CMB.2.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagatcaccatcacttgcccgggcagtcagggcattagctagtttatttagccttggatcagacaaaaacnggaaacncccctaagctcngatctatggtnctatcaactttgactaagggtcgggtacccagtcgtaaggttcacggtcggacgtaggtggaacttcggnggggaaacagtaacttccactctacaacaatcgagacacgcctgaccagtacctagaagtattttgaactttaaacttattacctcgtaaactaacctaaacctttaatacgttttaccacctttactcgtttacccgggccttaggggaaaccctaaaggtcggaaactaacgttaccaaaacgtccgtggtaacgtacctaggcccttaaacctctttccgttacgtc

SEQ ID NO: 330080 - DNA, 530 bp, Homo sapiens
  misc_feature: GZ8MTXP02JKJ5I.52.25.C03.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (522)..(522): a, c, t, g, unknown or other
  misc_feature (522)..(522): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagcagttattagcctggatcagcaaaaaccnggaaacncccctaagctcctgatctatggtncatcaactttgacgtaaggtggggtcccagtcaaaggttcaggtcgacagtggatcgtgggacagattcatcanacatcagcagcctgcagctgaatatttgactaaattattaactgttaccaaactacctttaaatacgtttaacctccttctaccgtttcggaccccttgggaacctaagtcggaccattaccgaaaacgtcttgaacggctacggctaaccgtntcgtactc

SEQ ID NO: 330081 - DNA, 574 bp, Homo sapiens
  misc_feature: GZ8MTXP02FN89R.52.25.C03.1.454.CMB.2.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (424)..(424): a, c, t, g, unknown or other
  misc_feature (424)..(424): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagggcattagcagttattagcctggtatcagacaaaaaccgnggaaacncccctaagctcctgatctatggtgcatctaaactttgacgtaaagggtcggggtcccagtacaacggttcaggcggcaggtggatgngggacagaattcactctacaactaatccgagacacgccctagccaggtaccctagaaagtttntttacgacttaaactttatactagtacctaaacttaccttaattacttaccttaccttactaccgtttccggaccgtacggtaacctaaggtacgaactactaaccgtaaaacgtacgtaggaacgtactacgactactactcgttcgtc

SEQ ID NO: 330082 - DNA, 558 bp, Homo sapiens
  misc_feature: GZ8MTXP02HQ3KG.52.25.C03.1.454.CMB.2.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (395)..(395): a, c, t, g, unknown or other
  misc_feature (395)..(395): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccggccagtcagggcattagcagttattagcctggtatcagacaaaaaaccgnggaaacncccctaagctccngatctatggtncatcaatttgactaaggtggggtcccatcgaacggttcagcggcaggtggatcgtggggacagattcactctcacaaatcagtcagccctgaccngcctagaacgttatttgacttaaacttatttactagtaccaaacttaccttaaattacgtttaactcctttactaccgtttccggccctacggggaaacctaaaggtcgaactataaccgaaaacgtacttcgtaacggctacgactaacctcttacgttctc

SEQ ID NO: 330083 - DNA, 629 bp, Homo sapiens
  misc_feature: GZ8MTXP02GSREL.52.25.C03.1.454.CMB.2.raw
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttattagcctggtatcagacaaaaccngggaaacncccctaagctcctgatctatggtncatacaactttgactaagggtcgggtcccatcgaacggttcagcggcaggtggatcgtgggacagattcactctcaacatcagcagtccctagcacggtacctagtaaacgttattttacggaccttaaaactttacttacctacggttaacctaaacctaacccgtttaaattaaccgtttaccttacccctttacgtaacccggtttttccgggcccccgttaagggggtaaaccctaaaagggtttcggaaaacctaacgttaaccgaaaaaccggttccgttagggcggtaccttacggacccacgtaacttcttacggtttaccc

SEQ ID NO: 330084 - DNA, 582 bp, Homo sapiens
  misc_feature: GZ8MTXP02I7UNY.52.25.C03.1.454.CMB.2.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagcgcagtacgacacgaccggtgctcgatttagtagtgtagatttgggtttgggggagtcagtcccagtcaggacacagcatggacatgagggtccccgctcggctcctggggctcctgctgctctggctcccaggtgccagatgtgacatccagttgacccagtctccatccttcctgtctgcatctgtaggagacagagtcaccatcacttggccgggccagtcagggcattagctagttattagcctggtatcagacaaaaccgagggaaacncccctaagcctcctgactctatggtnacatactaactttgcgaagggttcgggtccatacgaaggtccagcgnaggtgatcgtggggacagtacttcactctacacaatcagcagcctgacacgctagaattntttcgacttaaactttnttaacgtntaacctaacttaaccgtttaaattacgtttacccttcctttacgttaccgttttcccgggacccgttacgggaaacctaaaggtcgtaaactacgttaaccgaaaacgtacgtggttacgctcgactaccgtatcctgttacttac

SEQ ID NO: 330085 - DNA, 710 bp, Homo sapiens
  misc_feature: GZ8MTXP02GPJGL.52.25.C03.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtgacatccagttgacccagtctccatccttcctgtctgcatctgtagganacagagtcaccatcacttggccggccagtcagggcattagctagttattagctgtatcagacaaaacgaggaaacncccctaagctctgatctagtggtnctatactaacttgacgtagggtcgggtaccagtacgtaacggttcacggcggtacgaggtagagtcggtagggactagtaacttccactactacaaactactacgacgacgacgtcccgtacgccgaacgtaccgtaaggtaaagtttactttttaaggaacctttaaaacgttttacgtttaacctacgttaaacccttaaaaccgtttaaaaccttttaaacgttaaccgtttttacccctttaacccgtttaccctttaacccggtttttaccccgggaccccggttaaacgggggttaaaaccctaaaacgggttacggaaacctaaacgttaaaccgaaaaaaccggttccgttagggtaacggtacctacggttacccaaacccgtttacttaccgttacgtttaccg

SEQ ID NO: 330086 - DNA, 603 bp, Homo sapiens
  misc_feature: GZ8MTXP02IKY79.52.25.C03.1.454.CMB.2.raw
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctagttattagctggatcagacaaaacgaggaacncccaataagctcctagatcgtatggtancattctaaacgtttgacgtaaggggtcggtacccaagtacccgtaaagggttcaggccggtactaggtggacttcgtaggggaacctaggtaaactttcgaacttcaacacaaactcgaagtcaacgtcctaggacaacgtccgtagaaacgttctttacgaacttaaacgtttatactagtaaccaaacttaccgttaatacgtttacctaccttctacgtttccggccgtaagggaacctaaaaggtcggaaactaacgtaaccgaaacgtacgtggtcgactacgacctacctattcttacg

SEQ ID NO: 330087 - DNA, 601 bp, Homo sapiens
  misc_feature: GZ8MTXP02FMWUK.52.25.C03.1.454.CMB.2.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtgacatccagttgacccagtctccatccttctgtctgcatctgtagganacagatcaccatcacttggccggcagtcgagggcattagctagttattagctgtancagacaaaacgaggaacnccctaagctctgatctagtggtncatctaacgtttgacgtaacgggtcgggtaccagtacgaacggtcaggcgacaggtggatcgagggacaagtaactcactctacanatcagcagcccngacagtctagaaacgtttntttacgacttaaactttacttaactactaaacctaaacttaacctttaaattaccgtttacccttaccttaccgttacccgtttccgggaacccgttaaagggaaacccgtaaaggtacgaaactaacgtaaaacccgtaaaacggttcgtaggtaaccgtctaacgacctaacgttacttccgttactacc

SEQ ID NO: 330088 - DNA, 648 bp, Homo sapiens
  misc_feature: GZ8MTXP02GHM37.52.25.C03.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtccaccatcacgttgccggcagtcagggcattagctagtttattagcctggtatcagaacaaaaacgaggaaaaccncccctaagcctactagattcgtagtggtacactattactaaacgtttggaacggtaaggggttccggggtacccctaagttaccgtaaacgggtttccgaggacggacgtaaggtggacgttcggtaggggaactaaggtaaccttcactctacaactaataccagcagtcccgtagccagtacctaagtaagttagttttacgactttaaacttactttacacttaactaaactacctttaaattacctttaccttccttacctaacgtttcccggaacccgttacggaaaacccgtaaggtacgaaacctaactaaaccgtaaaacgtaccgtagtcgacgtacgaccactacttcttcgtttacc

SEQ ID NO: 330089 - DNA, 707 bp, Homo sapiens
  misc_feature: GZ8MTXP02IAF2L.52.25.C03.1.454.CMB.2.raw
  modified_base (293)..(293): a, c, t, g, unknown or other
  misc_feature (293)..(293): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccactccttcctgttctgcatctgtaggagacagagtcaccatcacgttcggccgggcagtcgagggcattagctagttattagctggtatcaagacaaaaccagggaacgcccctaagcctcngatctagtggtgctatactaacgtttgacgtaagggtcggggtaccctagtacgtaacggttcgaacggcggcgtaagggtcggtacgttccggtagggggaaactaagggtaaactttccaaccttactacaaacctaagtacacgaccgaacgtcccgtagaccgtaacgtacccgtaaggttaacgttacgttttacgtaccttaaactttactttaacgttacgtaaccctaaaactttaacctttaaaacgttactttaacccttccgtttaccttacccggtttaccggacccccggtttacgggaaaacccttaaggggtacgttaaaccaacgttaaccgaaaaaccgttagtacggttaaccgggctacggtaacccgtacctaacgtttcctttaccgtttccc

SEQ ID NO: 330090 - DNA, 621 bp, Homo sapiens
  misc_feature: GZ8MTXP02GIRTL.52.25.C03.1.454.CMB.2.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctccaggtgccagatgtgacatccagttgacccagtctccatccttctgtctgcatctgtaggagacagtgtcaccatcacttgccggcagtcaggcattagctagttattagcctggtatcaagaacaaaaaccgagggaaacncccctaaagcctccgtagatcgtatggtnactattactaaactttggacgtaaacgggttcggggaccctaagtacgaacggttcaggcggactaggtacggacttcggtagggaactaagtaacttccaactctacaacaatcgagcagtccgtacgcgaacgtccgtaagaaacgttagtttacaacttaaactttaacttacgtactaacctaaacttaaccgtttaattacgttaccttaccttcctaccgtttccgacccgttaacgggaaccctaaaaggttcggaaactaacgtacgaaaacgtcgttaagcgtactcgaccactactcgtactttacc

SEQ ID NO: 330091 - DNA, 531 bp, Homo sapiens
  misc_feature: GZ8MTXP02FWCKU.52.25.C03.1.454.CMB.2.raw
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (504)..(504): a, c, t, g, unknown or other
  misc_feature (504)..(504): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatcccttcctgtctgcatctgtaggagacagagtcaccatcacttgccgggccagtcagggcattagcagttattagcctggtatcagacaaaaacgagggaaacgcccctaagctcctgactctatggtgctatctaactttgacgtaaggtcggggtccatcgaaggttcaggcggcaggtggatcgtgggacagtaattcactctacacaatcaagcagccctagccagcctagaagtntttgactaaatttattactntacaaactacttaattacgttactcttctacttccggcctagggacctaaagtcgaacagtacaaacgtanggtaagctacgaccactatctcgttac

SEQ ID NO: 330092 - DNA, 568 bp, Homo sapiens
  misc_feature: GZ8MTXP02FSPBB.52.25.C03.1.454.CMB.2.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (437)..(437): a, c, t, g, unknown or other
  misc_feature (437)..(437): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctagttattagcctggtatcagacaaaaacgnggaaacncccctaagctctgatctatggtncatctaaactttgacgtaagggtcggggtacccagttacgaaacgggtttcaggcggacgtaggtggactcggtggggaactaaggtaacttccaactctacaactaatcaagcacgccctagaccagcctagtaaagtnttttagacttaaatttacttactgtaacaactaaccttaattacgttacctcttactacgtttcggaccctagggacctaaaggtcgaacacgttacaaaacgtctaggtgctagccactactctagttcc

SEQ ID NO: 330093 - DNA, 598 bp, Homo sapiens
  misc_feature: GZ8MTXP02GIU99.52.25.C03.1.454.CMB.2.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgcagtacgacacgaccggtgctcgatttagtagtgtagatttggggtttgggggagtcagtcccagtcaggacacagcatggacatgagggtccccgctcagctcctggggctcctgctgctctggctcccaggtgccagatgtgacatccagttgacccagtctccattccttcctgtctgcatctgtaggagacagagtcaccatcacttgccggcagtcgaggcattagctagttattagctggtatcaagacaaaaacgaggaaacncccctaagctctagatctagtggtnctatactaactttgacgtaagggtcgggtaccagtacgtaacggttcgaggcggacgtaggtcggatccggtagggaactaaggtaacttcaactctacaacaatcagcagcctagcagtcctagaattatttacgaacttaaactttacttactacttaacctaaaccttaacctttaaattacctttaaccttcctttaccgtaccgtttccggacccgtaggaaccctaaaggtcgaaactaacgtaacgaaaacgtctaggtgtacctacgaccaaccgttcttcgttactcc

SEQ ID NO: 330094 - DNA, 526 bp, Homo sapiens
  misc_feature: GZ8MTXP02GEYAK.52.25.C03.1.454.CMB.2.raw
  modified_base (277)..(277): a, c, t, g, unknown or other
  misc_feature (277)..(277): n is a, c, g, or t
  modified_base (402)..(402): a, c, t, g, unknown or other
  misc_feature (402)..(402): n is a, c, g, or t
tcagcgcagtacgacacgaccggtgctcgatttagtagtgtagatttgggtttgggggagtcagtcccagtcaggacacagcatggacatgagggtccccgctcggctcctggggctcctgctgctctggctcccaggtgccagatgtgacatccagttgacccagtctccatccttcctgtctgcatctgtaggagacagagtcaccatcacttgccgggccagtcagggcattagctagttattagcctggtatcagacaaaaaccagggaaacncccctaagcctcctgatctatggtgcatctaactttggtaaggtggggtcccatcaaaggttcagcgcagtgatcgtgggacagaattcactctacacaatcagcagcctgcagcctagaacgtnttttgacttaaactttattactgtacaaactaccttaaatacgttactccttctacgtttcggcctagggaaccaaagtggacactacaaacgtactcgtgctgacactactctcgtctctacc

SEQ ID NO: 330095 - DNA, 596 bp, Homo sapiens
  misc_feature: GZ8MTXP02G70NW.52.25.C03.1.454.CMB.2.raw
  modified_base (197)..(197): a, c, t, g, unknown or other
  misc_feature (197)..(197): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcaccatcacttgccgggcagtcagggcattagctagttattagctggtatcagacaaaacgaggaaacgcccctaagcctctagatctagtggtgactatactaactttgacgtaacgggtcggggtacccagtacgaacggttcaggtcggcaggtggatcggtgggaacagtaatcactctacaacatcagcagccctgaccagcctagaattacgtttagaccttaaactttagtactactactaaacttaccttaagttacttacctccttacgttaccgttccggacccgttacggggaacctaaaggtcggtaaactaacgtaccgtaaaaacgtccgttaggtaacggtacctacggtactaacccgtagttccgtacgtttccc

SEQ ID NO: 330096 - DNA, 597 bp, Homo sapiens
  misc_feature: GZ8MTXP02GJ68H.52.25.C03.1.454.CMB.2.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttctgtctgcatctgtagganacagagtcaccatcacttgccgggcagtcagggcattanctagttattgctggtatcagacaaaaacngggaaaccncctanctcnatctagtgnactatactacgttgacgtagggtcggacctagtacgacgtcaggcgngtaggtgagtcggacggactaagtacttccactactacaacgtatacgacgacacgccgtacgacctacgtacgtagtaacttagtttacgaacttaaactttacttacgtactacctaaacttaaccgtttaacttacctttaccttccttacggttaccgttccggacccgtaacgggtaaacctaaaggtacggtaaactaacgtaaccgtaaacgtacgtcggtaacgtactacgacctacgtacttcttacgtc

SEQ ID NO: 330097 - DNA, 654 bp, Homo sapiens
  misc_feature: GZ8MTXP02GIHEA.52.25.C03.1.454.CMB.2.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagctagttattagctggtatcaagacaaaaacgaggaaacncccctaagctctgatctatggtnctatctaactttgacgtaagggtcgggtcccatacgaaggttcagcggctagtggactcgtagggaactaagtattccgactctacaaactaatcgaagcgtacgccctaggaccacgtcctaaggtaaactttctttacgaacctttaaactttacttaccgtagtaaacctaaaccttaaccgttttaaattaccgtttaaccttccttaccgttaaccgttttccggggaccccgtttaagggggaaaaccctaaaaggttccggtaaaacctaacgttaaacccgtaaaaacgtaccgtttggaaccggttactacggaccctaaaccttaggtttccctacgttttaaccg

SEQ ID NO: 330098 - DNA, 637 bp, Homo sapiens
  misc_feature: GZ8MTXP02H1HP2.52.25.C03.1.454.CMB.2.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (391)..(391): a, c, t, g, unknown or other
  misc_feature (391)..(391): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctggtaggagacagagtcaccatcacttgccgggcagtcagggcattagctagttattagcctggtatcagacaaaaaccgaggaaacncccctaagcctactgattctatggtnactatactaactttgacgtaagggtcgggtaccagtcgaacgggttcaggcggactaggtggactcgtagggaacaggtattcctacncttacactaatcaagcacgcctgcacgacctaagaacgttattttcggaacttaaactttaactttactagttaacctaaaaccttacctttaaaattaccgtttaacccttccctttaaccgttaccgtttacccggggtaccccgttaggggtaaaaccccttaaaagggttcgaaaacctaacgttaaaccgaaaacggtaactcggttaacggctacggaccctactacgttccttacgtcc

SEQ ID NO: 330099 - DNA, 682 bp, Homo sapiens
  misc_feature: GZ8MTXP02JWEI2.52.25.C03.1.454.CMB.2.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
  modified_base (313)..(313): a, c, t, g, unknown or other
  misc_feature (313)..(313): n is a, c, g, or t
tcagcgcagtacgacacgaccggtgctcgatttagtagtgtagatttgggtttgggggagtcagtcccagtcaggacacagcatgggacatgagggtccccgctcagctcctggggctcctgctgctctggctcccaggtgccagatgtgacatccagttgacccagtctccatccttcctgtctgcatctgtagganacagtcgtcaccatcacgttcgccgggccagtcagggtcattagctagttattagctggtatcagacaaaacgaggaaacncccctaagcctaccgtagacttctaagtcggtanactaattaccgtaacgtttcggacgtaacggggtcggggtaccccaagttaacgtaacggttcaacggtcggtacgtaggtacggacttcggacgggaacgtagtaacttccgacttacctacaactaaacgtcgagtaccagccctagccaacgtaccgtaagtaacgttacttttacgaacttaaacgtttacttacctacgtaacctaaacttaacctttaaacgttactttacccttacttacccgttaccgtttacccggacccgttaacggggtaaaaccctaaacggtccggtaaactaacgtaaccgtaaaacggtaacgttcggaacggtctaccgtactacctagtttcctcgtttacc

SEQ ID NO: 330100 - DNA, 534 bp, Homo sapiens
  misc_feature: GZ8MTXP02ISMHF.52.25.C03.1.454.CMB.2.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (527)..(527): a, c, t, g, unknown or other
  misc_feature (527)..(527): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagcagtttattagcctggtatcagacaaaaaccgagggaaacgcccctaaagcctacctgatctatggtncatcaactttgacgtaagggtcgggtacccatcgtaaggttcagcggcaggtggatcgtagggacagtaacttcacttctacaactaatcagcagccctgacngcctagaatntttgactaaactttnttacngtaccaactacttagtacgttactcttactacgtttcgacctgggaacctaaaggtcgaacatacgaaaactctagtcgctacgacaactntctactc

SEQ ID NO: 330101 - DNA, 563 bp, Homo sapiens
  misc_feature: GZ8MTXP02GHRN2.52.25.C03.1.454.CMB.2.raw
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttggccgggcagtcacccgggntattagctagttattacgctgtancagaacaaaacgaggaacncctanctctnatctagtgtnctatactagttgacgtagggtcggtaccagtacgtaggtcgagcgataggtgagtcggaggacagtactcactactacaactancagcacgcagcagtacgtagtagttactttacgacttaatttacttacgtactaacttaacttaaccttaagtttacttaccttcttactaccgtttccggaccgtaacggtaactaaggtacgaactaacgtaacgaaacgtacgtcggtcgtctacgacctactacgttcgttacgttc

SEQ ID NO: 330102 - DNA, 523 bp, Homo sapiens
  misc_feature: GZ8MTXP02FFSW6.52.25.C03.1.454.CMB.2.raw
  modified_base (276)..(276): a, c, t, g, unknown or other
  misc_feature (276)..(276): n is a, c, g, or t
  modified_base (355)..(355): a, c, t, g, unknown or other
  misc_feature (355)..(355): n is a, c, g, or t
  modified_base (403)..(403): a, c, t, g, unknown or other
  misc_feature (403)..(403): n is a, c, g, or t
  modified_base (520)..(520): a, c, t, g, unknown or other
  misc_feature (520)..(520): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttattagcctggtatcagacaaaaaccagggaaacncccctaagctcctgatctatggtagcatcaactttgcgtaagggtggggtcccatcaacggttcagcggcagtgatcgngggacagacttcactctcacaatcagcagcctgcagcctgaaacgttntttagactaattatactgtacaactacttaatacttactccttactacgttcgacccgtacgggaacctaaaggtcgactactaccgaaaacgcgtgcgtctacgaccactatcctntac

SEQ ID NO: 330103 - DNA, 637 bp, Homo sapiens
  misc_feature: GZ8MTXP02HEW81.52.25.C03.1.454.CMB.2.raw
  modified_base (282)..(282): a, c, t, g, unknown or other
  misc_feature (282)..(282): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccgggcagtcgagggcagttagctagttatttacgcctggtatcaagacaaaaaccgaggaaacncccctaagccttcctagactctagtggtagctaagtctaacgttttcgacggtaaagggtcggggtacccaagttacgaacggttcaggtcgacgaggtcggatcggtaggaactagtaacttcgactctacaacatcgacncgacgtccncgacacgacgtagtaacgttatttacgtaacttaacttacttacgtactaacctaaacttacttaaattacgtttaccttacctttaccgttaccgtttccggaccggttaaacggtaaaccgtaaaggtacgtaaacctaacgtaaacgtaaaacgtacgttcggtaacgtactacgtacctaccgtacgtttcttacgttac

SEQ ID NO: 330104 - DNA, 773 bp, Homo sapiens
  misc_feature: GZ8MTXP02GFZSK.52.25.C03.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (475)..(475): a, c, t, g, unknown or other
  misc_feature (475)..(475): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagacgtcaccatcacttgccggcagtcagggcattagctagttattagctggtatcagacaaaacgaggaaacncccctaagctactgactctagtggtnactatactaacgttgacgtaagggtcggtaccagtcgtaaacggttcgaggcggacgtaggtacggtatccggtagggaactaaggtaaacttccaaccttctaaccaaacgtaaactccgaacggtacacggtcccgtaggaccgtaacggtacccgttaaaggtaaaccgtttntttttaaacgaaccttttaaaacgttttactttaaaccgttacgttaaaaccctaaacctttaaaacccgtttttaaaatttaaccggtttttaacccctttaccccgttttaaccgttaaccccggtttttaccccggggaaccccggtttaaaacggggtaaaacccccgttaaaaagggggtttacccgaaaacccgttaaactttaaaacccggaaaaaacggttccgttaggggtaaccggtaccttaaccggaaaccgtaaccctacgtttacccggtttacgtttaacccc

SEQ ID NO: 330105 - DNA, 536 bp, Homo sapiens
  misc_feature: GZ8MTXP02HDOMT.52.25.C03.1.454.CMB.2.raw
  modified_base (415)..(415): a, c, t, g, unknown or other
  misc_feature (415)..(415): n is a, c, g, or t
  modified_base (534)..(534): a, c, t, g, unknown or other
  misc_feature (534)..(534): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagactagtgtcaccatcacttgccggcagtcagggcattagctagttattagcctggtatcaagacaaaaaccgaggaaacacccctaagctacctgatctatgtgcaatctaactttgacaaggtcggccagtcaaggtcagcgacgagtacgatcgtagggactaagtattcactctacaagactacagacagccctagcaggcctaggaatatttanaccttaaatttatactagtactaaactaacctttaatacttacttccgtataccgtttacgccttaggacaaagtcgactactaccaaaacgtatcgaagtcacgaccatactaccttntc

SEQ ID NO: 330106 - DNA, 605 bp, Homo sapiens
  misc_feature: GZ8MTXP02I6CXW.52.25.C03.1.454.CMB.2.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
  modified_base (580)..(580): a, c, t, g, unknown or other
  misc_feature (580)..(580): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtagganacagtgtcaccatcacttcgccggacagtcgaggcattagctagttattgctggtatcagacaaaacgaggaaacnccctaagcctactgatctagtggtacncatactaacgtttgacgtaaggggtcgggtacccagtacgaacggttcacggacggactagggtcggagtcgggtacgggaactagtaaacttccaactctaccaanaacgtcaagccgaatcccgtagaccgagtaccttagaagtttactttacgaaccttaacgtttacttacgtactaaccttaaacctaacttaatttacttaccttcttactacgtttccgacccgttagggaaacctaaaggtccgaaactacttaaccgaaacgtgttcgnggtacacacaacctgttcctattcc

SEQ ID NO: 330107 - DNA, 615 bp, Homo sapiens
  misc_feature: GZ8MTXP02GEB25.52.25.C03.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (447)..(447): a, c, t, g, unknown or other
  misc_feature (447)..(447): n is a, c, g, or t
  modified_base (609)..(609): a, c, t, g, unknown or other
  misc_feature (609)..(609): n is a, c, g, or t
tcagcgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcaccatcacttgccggcagtcagggcattagctagttattagctggtatcagacaaaacgaggaaacncccctaagctcngatctatggtnacatctaactttgacgtaagggtcggtacccagtcgaaggttccaggcgacgtaggtggatccgtagggactagtaacttcactctacacaatcaacgcaacgtccctagacctacgacctagaaacgttacttttagacctttaaaactttntttaacctcgttaacccaaacctttaacccgtttaaaattcccgtttaaccttacctttccgttaacccgtttccgggaaccccgttaggggtaaaccctaaaggtcggtaaactacgtaaaccgaaaacggtcttggaacgctacgacctaccagttcctntttacc

SEQ ID NO: 330108 - DNA, 531 bp, Homo sapiens
  misc_feature: GZ8MTXP02I7403.52.25.C03.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttggcccggcagtcagggcattagctagttattagctgatcagacaaaaacgaggaaacncccctaagcctacngatctatggtgcatactaagtttgacgtaagggtcgggtccagtcaaggttcagcgnagnggatcgtgganaagtactcactctacaacgtatcagcagcctgcctagcccttagaagttctttagactaaactttatactcactaaaactacctttaaatacgttactccgtttntaccgtttcgaccgtacggaactaagcgtanaacgtacaaaacgtcngtgactgacactatccgtatc

SEQ ID NO: 330109 - DNA, 674 bp, Homo sapiens
  misc_feature: GZ8MTXP02JU74U.52.25.C03.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccggcagtcagggcattagctagtttattagctggtatcagacaaaacgaggaaacncccctaagcctctgatctatggtgctatcctaaactttggacgtaaaggggtcggggtaccccaagttaccgaaacggggttcacggtcgggactaagggtcggtaattccgggtagggggaactaaaggtaaactttccaacctttcctaccaaacctaaataccacggcaacggtccctagaccaacgtcccgtaaggtaaagttactttttacgaccttaaactttaacgtttaacctacgttaaccctaaaactaaccctttaaattacgtttaacccttcctttactaaccgtttcccggaccccgttaggggaaacccctaaaggtcggtaaacctaactaaccgaaaaccgtaagtggtcgaccgttcgaccctaaccgtctacgtttacgtcc

SEQ ID NO: 330110 - DNA, 584 bp, Homo sapiens
  misc_feature: GZ8MTXP02HYCCX.52.25.C03.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacgttgccggcagtcagggcattagctagttattagcctggtatcagacaaaaacgaggaaacncccctaaagctcctgatctagtggtncgtatactaactttgacgtaagggtcgggtacccagtacgtaaggttcaggcggactaggtggactcggtgggaactaggtactttcgactctacgaactaatcgagcacgcctgaccagctagagtatttagacttaaacgtttacttacagtacaaacgtacttaatacgttactcttctaacgttccgcttaacggaaccttaaagccggtaaactacgttaaccaaaacgtacgtacgggtcgtacgttacgacctacctacggtttctttaccgttcc

SEQ ID NO: 330111 - DNA, 642 bp, Homo sapiens
  misc_feature: GZ8MTXP02JLFKO.52.25.C03.1.454.CMB.2.raw
  modified_base (610)..(610): a, c, t, g, unknown or other
  misc_feature (610)..(610): n is a, c, g, or t
  modified_base (620)..(620): a, c, t, g, unknown or other
  misc_feature (620)..(620): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtcctccatccttcctgtctgcatctgtaggagacagtgtccaccatcacgttggccgggccagtcgagggcattagctagttattacgcctaggtatacaagacaaaaaccgaggaaaccgcccctaagcctaccgtgactctagtggtgactagtactaagtttcgacgtaaacgggtcgggtaccctagtacgtaacggttccaagggccggatagggtaggacttccgggtaggggaaactacggtaaacttccgtaacttcctactaaacgactaccgagtaccagtcccgtacgaccgacgtccgtaaaggtactttagtttacgacctttaaactttacttacctacgtaacctaaacttaacctttaatacgtttaccttcttcgtaccgtttccggaccgtaacggaacctagggtacactaactaccgaaacgtnttgaacgtcncgacactcgttactcgtttacc

SEQ ID NO: 330112 - DNA, 608 bp, Homo sapiens
  misc_feature: GZ8MTXP02J2P26.52.25.C03.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttggccggcagtcaggcattagctagttattagcctggtatcagaacaaaaccgaggaaacncccctaagctcctgactctagtggtgactatctaagtttgacgtaaagggtcggggtacccagtacgaacggttcagacggtacgaggtggacttccggtaggggaaacctaagtaactttccaactttactaccaaaactaaacgttcgaacggtaccaacgggtccctagggaccaaacgggtccttaaggtacgttacttttacgaaccttaatttacgtactactactaaactaccttagttaactccttctacttacttcgacctagggaacctaagcgaaactacgtacgaaacgtacgtgcggactcgaccaactctacgtcttac

SEQ ID NO: 330113 - DNA, 634 bp, Homo sapiens
  misc_feature: GZ8MTXP02J0XZV.52.25.C03.1.454.CMB.2.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagctagttatttagcctggtatcagacaaaaaccgaggaaacncccctaagctcctgatctagtggtncatctaactttgacgtaagggtcgggtacccagtcgtaacggttccaggcggactaggtggatcggtagggaacagtaattccaactctacaactaactcacgcacgcctgacacgtactagaagttattttacgacttaaactttactacgttactaacctaaaaccttaactttaaacgtttaacctttacccttacccgtttaccgttaaccgtttcccgggacccgttacggggtaaaccctaaagggtcggaaactaacgtaacgtaaaaccgtaccgttagtaacggtactacggaccctaaccgtactttccgttactttaccc

SEQ ID NO: 330114 - DNA, 579 bp, Homo sapiens
  misc_feature: GZ8MTXP02IJAET.52.25.C03.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcaccatcacttggccgggcagtcagggcattagctagttattagcctggatcagacaaaaacgaggaaacncccctaagctcagatctatggncaatctaaactttggacgtaaagggtcggggtacccaagtacgaaacggttccaggcgggtactaggtaggacttccgtaggggaacaaggtaattaccacttcactaaaccaatacacgacacgcctcgacacgtacctagtaagtatttatactaacttattactactactaactaacttaaattacttacttacttaccttactttaccgtccgtacggtaacgaaacgtacgactaactacgtaaacgtaacgtagtgcgtacactacactctacttc

SEQ ID NO: 330115 - DNA, 614 bp, Homo sapiens
  misc_feature: GZ8MTXP02GON21.52.25.C03.1.454.CMB.2.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttcgacccagtctccatcccttcctgtctgcatctggtaggagacagagtcaccatcacgttggccgggcagtcagggcattagctagttattagctgtatcagacaaaacaggaaacnccctaagctctagatctagtaggtnactatctaatttgacgtaagggtcggtaccagtactaacgggtcaacgcgggacgtaggtaggtacgtccgggtagggaactaaggtaacttacacctctacaaacagtacagacacgctcgcgaacgtactaaggaactttatttacgacttaaaacgtttactaactacgtaactaaacctaacctttaaattactttacctaccctttctaccgtttccggacccgttaacgggaaaccctaaggtacgaacctaacttaaacggaaactacgttggaacggtacacgtacctactacttcgtactttac

SEQ ID NO: 330116 - DNA, 649 bp, Homo sapiens
  misc_feature: GZ8MTXP02I9Y62.52.25.C03.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagatcaccatcacttgccgggcagtcagggcattagctagttattagctggtatcagacaaaaaccgaggaaacncccctaaagctacctgatctaagtggtagctaatactaacgtttgacgtaagggtcggggtcccaagtacgtaaacggttcaaggtcggactaggtaggactcgtaggggaactaagtaaacttcaactctacaaacatcaacgcaacggcctagacacgtacctaggaaacgttattttagaccttaaagtttaacttactacgttaacaaaccttaacgtttaaactaacgtttacctactttacccttacgtttaccgggacccgttaacgggtaaaccgtaaaacgttacgggaaactaacttaaacgaaaaacccgtaagttcggaaccggtcttaacggacctaaaccttactttaccgtacgtttacc

SEQ ID NO: 330117 - DNA, 588 bp, Homo sapiens
  misc_feature: GZ8MTXP02FPYTA.52.25.C03.1.454.CMB.2.raw
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
  modified_base (581)..(581): a, c, t, g, unknown or other
  misc_feature (581)..(581): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattgcagttattagcctggtatcagacaaaaaccgaggaaacgcccctaagctcctgatctatgtganatacaactttgacgtaagggtcggggtcccagttacgaaggttcaggcggcaggtggagtcgtagggactagaattcactcacaactancagcacgcctaggcaagtcctagtaaacttatttacgactaaactttacgtttaactgtaacctaaacttaccctttaaaattaccgtttacttccttacgtaccgtttccgggacccgtacgggaacctaaaggtcggaaacctaacgtaaccgaaaacgtcttaggtcggctacgaccacctagttccgtntttaccc

SEQ ID NO: 330118 - DNA, 591 bp, Homo sapiens
  misc_feature: GZ8MTXP02FITYT.52.25.C03.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtntcaccatcacttgccgggccagtcagggcattagctagttattgctgtancagacaaaacgnggaacncccctaagctctgatctatggnctatctaactttgacgtaagggtcggaccagtacgaaggttcaggcggtcaggtgatcgtagggactagtaacttcaacttctacaacatcgagcagcctagcagcctagaaagttatttagacttaacttacttactacgttaacaaactaccctttaaatacgtttaccttccttactaccgttttcccgggaccttacgggtaacctaaaggtacgtaaactaaacgttaaaccgaaaaccgtcgttacggtcggtaccttacgaccctaccgttaactccggttacgtttaccc

SEQ ID NO: 330119 - DNA, 626 bp, Homo sapiens
  misc_feature: GZ8MTXP02I0HP1.52.25.C03.1.454.CMB.2.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatcccttcctgtctgcatcgtagtagganacagtgtcaaccatcacgttggccgggcagtcgagggcattagctagttattacgctggatcaagacaaaaacgacggaaacgcccctaagctccgtagacttctagtcggtnactactctaaacgtttgaccggtaaagggtcggggtaccccaagttcgaaacggttcaggcgacgtaggtggtatcggngggaatacgtaactcactctacaacatcagcancctgcacgctagaagttntttacgattaacttatacgtactaaccaaacttaacctttaagtactttaccttaccttacttaaccgtttcccgggaccgttacgggaaaacccttaaggacggtaaacctaaacgtaccgtaaaaacgtctgggtaacgtaccgttacggaaccttacctacgttaccgtttacgttaccc

SEQ ID NO: 330120 - DNA, 804 bp, Homo sapiens
  misc_feature: GZ8MTXP02JNSA6.52.25.C03.1.454.CMB.2.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagcgcagtacgacacgaccggtgctcgatttagtagtgtagatttggggtttgggggagtcagtcccagtcaggacacagcatggacatgagggtccccgctcagctcctggggctcctgctgctctggctcccaggtgccagatgtgacatccagttcgacccagtcctccacttccttcctgtctgctatctaggtagganacagtgtaccaccatcacgttcggccggccagtcgagggcagttagctagttattagctgtatacagaacgaaaacgaaggaaaccaccccgtaagcctacgtagtatacgtagnggtatacaattacgtaacgtttcgacggtaacggggttccgggtaccctagtaacgtaaccgggttacgacggtacggacgtacggtaggtactcgggtagggaactaacgtaacgtctacctacgttacaaacttactacgacgtaccgagtcccgtagaccccgacggttaccttagggtaaaactttaggtttttaaccaaccgttttaaaacgttttaacgtttaacccgttacgttaaaaccctaaaaccgtttaaaccctttttaaaacggtttaccgtttaccctttaaaccgtttcccccggtttaaaaccgttttcccgggaacccccgtttaaaacgggggaaaccccgttaaaaagggtccggttaaaacttaaaaccggttaaaccgaaaaaccggtttaaccgtttcgggggtaacgaaacccgtttcgaaaacccctaaccctttggtttacccgttacgtttttacccc

SEQ ID NO: 330121 - DNA, 657 bp, Homo sapiens
  misc_feature: GZ8MTXP02JLJUN.52.25.C03.1.454.CMB.2.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagtgtcaccatcacttggccggcagtcgagggcagttagctagttattagcctggtactcgaagaacaaaaaccgagggaaacgtcccctaagcctcctagattcgtagtggtanactattactaacgtttggacgtaaacggggtcgggtaccctaagttcgtaaacggttcgaggcggacgtaggttcggacttcgggtagggaactaaggtaacttcactctacaaactaatcgagacacggtcctacggacaagtaccgtaggtaacttagttttacgactttaaactttacttaacctcgtaaacctaaaccttaactttaaacgttactttaccctccgtttacttaccgtttacccggaccgttaaacgggaaacctaaagggttacgaacccttagtaaaaccgtaaacggtacgttggaacgactacggactactacttcgtactttcc

SEQ ID NO: 330122 - DNA, 596 bp, Homo sapiens
  misc_feature: GZ8MTXP02G1XQW.52.25.C03.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatgcagttgacccagtctccatccttcctgtctgcatctgtagganacagatcaccatcacttgccggcagtcagggcattgctagttattagcctggtatcgagacaaaaaccgaggaaacncccctaagctcngatcatggtgacatctaaactttcgacgtaaacggtcgggtcccatacccgtaaggttccaggcggtacaggtggactcgtagggaactaagacttacgtactactacaactaacncaagacaggcttcggacaacggtcctagtaaagttnttttacgacttaaactttattactagtaacctaactaacctttaattacgttacttcctttacgtactttacccggggcccttaggggaaaccaaacggttggaaactaacgtaacgtaaaacgaacgtggtacggactcaacacttaactctttacg

SEQ ID NO: 330123 - DNA, 709 bp, Homo sapiens
  misc_feature: GZ8MTXP02I0WPD.52.25.C03.1.454.CMB.2.raw
  modified_base (285)..(285): a, c, t, g, unknown or other
  misc_feature (285)..(285): n is a, c, g, or t
tcagcgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcgagggcagttagctaagtttattagcctggtatacgaagaacaaaaaccgaggaaaccncccctaagcctccgtagattacgtagtcggtcgactaactccttaaacgtttggaccggtaaacggggttccggggtacccctaagttaccgtaaacgggttccaacggggccggtacgtaaggtcggtacgtcgggtacggggaaactaaaggtaacttaccacttactacaaacctaataccgacgctacgcctggacctagtacctaagtaaacgttgtttaacgacctttaaatttacttacgttacttaacctaaacctaaccctttaaattaccgtttaaccttaccctttaccgttaccgtttaccgggtacccggttaacgggtaaaaccgtaaaggtccgtaaactaacgttaaccgaaaaacgttccgttaggaacgtacgtacgtacctaacctactttaccgttacgtttcc

SEQ ID NO: 330124 - DNA, 544 bp, Homo sapiens
  misc_feature: GZ8MTXP01EB5UA.2.76.G10.1.454.CMB.2.raw
  modified_base (369)..(369): a, c, t, g, unknown or other
  misc_feature (369)..(369): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggaggcacctcaacatcgggctgataatgtgtactggtacagcaggtcccaggaaccgacccccaaactcctcatctctcacaataatcacgccggcctgaggacgtcccctgaacccgatttccnctcgccctccaaagttcccggcacctcacgcctccctggccatcagtggcctcgggccgaggagtggaggctgattattactgtgcgtagagtggagtgacgaaccgtaggttggtcgttattcttcgttcggtaaccgtcggaaccgaacggtacgaccgtccgttcgtaaccg

SEQ ID NO: 330125 - DNA, 531 bp, Homo sapiens
  misc_feature: GZ8MTXP01EQW19.2.76.G10.1.454.CMB.2.raw
  modified_base (218)..(218): a, c, t, g, unknown or other
  misc_feature (218)..(218): n is a, c, g, or t
tcagacgctcgacacacgaccggtgctcgatttagtcactcatacaggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttctggagcacctccaacatcgggctgataatgtgtactggtacaagcaggtccccaggaaccacccccaaatcctcatctctcacaataatcagccggcctcgaggactcccctgaacccgatttcctctcgccccttaccaaagttccccggcaccctcacgccctccctggcccatcagtgggctccgggcgaggagtgaggctgattatctgtgctaggagtgggatgacaacgtgggttgtcttattcgttcgttcggccgtgggaaccaggtccaccgttccgttggc

SEQ ID NO: 330126 - DNA, 491 bp, Homo sapiens
  misc_feature: GZ8MTXP01EN75Z.2.76.G10.1.454.CMB.2.raw
  modified_base (474)..(474): a, c, t, g, unknown or other
  misc_feature (474)..(474): n is a, c, g, or t
  modified_base (481)..(491): a, c, t, g, unknown or other
  misc_feature (481)..(491): n is a, c, g, or t
tcagacgctcgacacacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggcttgtttatttctgttcagcacgggatcgccagccggaatggacaagttgggtattcgggcggagggaccaaggttgaccgtctaagtcagccaaggctcgcccctcggtcactctcgttccccgccctcctctgtcgagccgtctgagcgggctgggcaaggcncattagnnnnnnnnnnn

SEQ ID NO: 330127 - DNA, 605 bp, Homo sapiens
  misc_feature: GZ8MTXP01DZVW0.2.76.G10.1.454.CMB.2.raw
  modified_base (217)..(217): a, c, t, g, unknown or other
  misc_feature (217)..(217): n is a, c, g, or t
  modified_base (463)..(463): a, c, t, g, unknown or other
  misc_feature (463)..(463): n is a, c, g, or t
  modified_base (507)..(507): a, c, t, g, unknown or other
  misc_feature (507)..(507): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagagggtcaccatctcttgtctggagcacctcaacatcgggctgataatgtgtactggtacaagcaggtccccaggaaccgacccccaaatcctcatctcctacaactaaatatcacgccgcctagaggtacctcccacgaaccgtcttcctcgtccgtccctaacgtaccggtcccgaccctaccctacgaccgtcccctccgtcgacctactcgtacgggtcggcccgtcccgggacggaaggnggtggacggtcgtagtattacgttgtgtcgagaggtggtggtanaacgtaaccgttacgggtgggttcgtactttcttccgttcggttaccggtaacggtacgggtaacgtacggtccgttacccgttcgttcggtaacccg

SEQ ID NO: 330128 - DNA, 627 bp, Homo sapiens
  misc_feature: GZ8MTXP01C1X6A.2.76.G10.1.454.CMB.2.raw
  modified_base (220)..(220): a, c, t, g, unknown or other
  misc_feature (220)..(220): n is a, c, g, or t
  modified_base (449)..(449): a, c, t, g, unknown or other
  misc_feature (449)..(449): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtctcgggtccccggnaggaggtcacatctcttgtctggagcacctcaacatcgggctgataatgtgtactggtacaagcaggtcccaaggaaccgacccccaaatcctcatctctacaacaaatatcacgccggcctgacggactccctgaacccgtatttcctccttcgcccctaccgaaacgtcccggactacctcacgccctccctggccctatcgacggtcgggcctccggggccgaggngtcggagggtctaggtatttacgttacgtgtagcgtaagggtagtggggtaatcggaaccgttaaaccggttgggggttacgttacctttaacgttccgttcgtttacccgggtaaccggtacggggtaaccctaaacggggttcccttaaccccggtttccgtttccgggtaacccg

SEQ ID NO: 330129 - DNA, 518 bp, Homo sapiens
  misc_feature: GZ8MTXP01DMTDH.2.76.G10.1.454.CMB.2.raw
  modified_base (219)..(219): a, c, t, g, unknown or other
  misc_feature (219)..(219): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagaggtcaccatctcttgtctggagcacctcaacatcgggcgtgataatgtgtactggtacaagcaggtcccaggaaccgacccccaaatcctcatctctcacaataatcacgccggcctcaggactcccctgcccgtattcctctcgccctcaacgtcccgcacctcacgccctccctggccatcagtgggctccgggccgaggcgtgaggctgtattatacgtgtgcgaggatgggntgacacgtgggttncttattcgttcttcggaacctgggaaccaggtcaccgtcgttggcc

SEQ ID NO: 330130 - DNA, 496 bp, Homo sapiens
  misc_feature: GZ8MTXP01B79YD.2.76.G10.1.454.CMB.2.raw
  modified_base (248)..(248): a, c, t, g, unknown or other
  misc_feature (248)..(248): n is a, c, g, or t
  modified_base (487)..(496): a, c, t, g, unknown or other
  misc_feature (487)..(496): n is a, c, g, or t
tcagacgctcgacacacgaccggtgctcgatttagtcactcatacagggtcctgggcccagtctgtgctgactcatccaccctcagcgtctgggccccccgggcagagggtctccatctcttgttctggagtcacttccaacatcggaaataatgatgtgagctggtaccagcaggtcccaggaaccgcccccaaatcctcatctataccaatgatgtgcggccctcgaggggtccctgaccgattcnctgcctcaagtctggcacgtcagccttcctggacatccgtggcctccagtctgcgatgaggtcttgttttatttctgttcagcgacgggatcgccaggccggaatggactaagttgggtattcgggcgggagggaccaagttcgaccgtctaagtcacgccaaggctacgccccgtcgtcactctcgtcccaccctctctgtcgacgcgtcgtgacgcgggcgtggcaggcgcgattgnnnnnnnnnn

SEQ ID NO: 330131 - DNA, 589 bp, Homo sapiens
  misc_feature: GZ8MTXP01BY9NM.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctcaacagtcgggctgataatgtgtactggtacaagcaggtcccaggaaccacccccaaactcctcatctctacaacaatactcacgccggcctgacggacgtcccctgaacccgtattcctctcgccctaccgaacgtcccgctaccctcacgcccctccctggacccatccgaggtcgggcctcccggggacgaggagtggaggtctggtattatacgtggtgcgagggatggggatcggaacttaccggtggggttctacgtttattccgttccgttccgggtaaccgttcgggggaaccctaagggtcccgttacccggtccgtttgggaacccg

SEQ ID NO: 330132 - DNA, 485 bp, Homo sapiens
  misc_feature: GZ8MTXP01CO4YV.2.76.G10.1.454.CMB.2.raw
  modified_base (453)..(453): a, c, t, g, unknown or other
  misc_feature (453)..(453): n is a, c, g, or t
  modified_base (475)..(485): a, c, t, g, unknown or other
  misc_feature (475)..(485): n is a, c, g, or t
tcagacgctcgacacacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacgccccaaactcctcatctataccaatgatgtgcggccctcaggggtccctgaccgattctctgcctccaagtctggcacgtcagccttcctggacatccgtggcctccagtctgcggatgaggctgttttatttctgttcagcacggatcgcagcgaatggacaattgggattcgggacggagggaccaaggttcgaccgccctaagtcacgccaaggcctcgccccctggtccactctcgtcccaccctctctgtcgacgcgtctgngcgggctggcaaggcgcattgnnnnnnnnnnn

SEQ ID NO: 330133 - DNA, 520 bp, Homo sapiens
  misc_feature: GZ8MTXP01C0UIV.2.76.G10.1.454.CMB.2.raw
  modified_base (218)..(218): a, c, t, g, unknown or other
  misc_feature (218)..(218): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagagggtcaccatctcttgtctggaggcacctccaacatcgggctgataatgtgtactggtacaagcaggtccccaggaaccacccccaaatcctcatctctcacaatatcagcggcctnagactccctgccgattcnctgccctcaagtcccgcacctcacgccctccctggccatcgaggtcgggcctccggggccgaggngtggaggtctgattagttacgtgtgcaggatgggatgacacgtgggntcgttattcgttcttcggaacctgggaacctaaggtccacgttcgttggtcc

SEQ ID NO: 330134 - DNA, 533 bp, Homo sapiens
  misc_feature: GZ8MTXP01EIJJJ.2.76.G10.1.454.CMB.2.raw
  modified_base (199)..(199): a, c, t, g, unknown or other
  misc_feature (199)..(199): n is a, c, g, or t
  modified_base (488)..(488): a, c, t, g, unknown or other
  misc_feature (488)..(488): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtctgggtcccccggcagagggtcaccatctcttgttctggagcacctcaacatcgggcgtgataatgtgtactggtacaagcaggtccccaggaaccgacccccaaactcctcatctctcaacaataaacgtcaacgccggcctgaggacgtcccctgaacccgatttctcctgcccctaccgaaagtccccggcacctcacgccctcctggccatcagtggctccgggccgaggatgaggctagattattactgtgcgaggtatgggatgacaaccgtgggttncttattcttcttcggaactgggaacacggtcacgtccgttggaac

SEQ ID NO: 330135 - DNA, 646 bp, Homo sapiens
  misc_feature: GZ8MTXP01AGCHI.2.76.G10.1.454.CMB.2.raw
  modified_base (256)..(256): a, c, t, g, unknown or other
  misc_feature (256)..(256): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcctccgggcagaggtcaccatctcttgtctggagcacctccaacngtcgggcgtgataatgtgtactggtacaagcaggtcccaaggaaccacccccaaactcctcactctctacaacaataactccagccggcccctcgaggtaactcccctgacccgtatttctcctcgccctaccgaaacgtcccggcctaaccctcacgtcccctcccgtcggccctatccgaggtcgggccgtcccggggaccgagggggactcgggaacggtctagtaactttagttaccgtggtcgcgaaggtagttgggggaattcgggaaacccgtaaaccggttgggggtacgtccttttaacgttccgtttacccggtttaaccggggaacccgttcgggggaaccctaacgggttcccgtaaccccgttccgtttaaccgggg

SEQ ID NO: 330136 - DNA, 693 bp, Homo sapiens
  misc_feature: GZ8MTXP01DWL5H.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcggggtcccccggnagagggtcaccatctcttgttctggagcacctccaacatcgggctgataatgtgtactggtacaagcaggtaccccaaggaacccgaacccccaaactccctacacttcctctacaacaaataactcaacgccggcctgaacggacgtcccctagaacccgtatttccgtactcgcccctaccaaacggtcccgaccaacccttcgacgtccccttcccgtacgggacccctaagttccgaacggggttccggggccccgttccccggggggacccggaaaggggtacgttaccggggtaggggttcccttagggtaaaccttttaagtttaccgttgggttaacgccggtaagggtacggttgggaacgtaacgaaccgttaaaccggttgggttgtacctttagttccgttcgttccgggaacctacggggaaccctaagggtccttacccggttcgtttcgggaaccc

SEQ ID NO: 330137 - DNA, 546 bp, Homo sapiens
  misc_feature: GZ8MTXP01BSI4H.2.76.G10.1.454.CMB.2.raw
  modified_base (220)..(220): a, c, t, g, unknown or other
  misc_feature (220)..(220): n is a, c, g, or t
  modified_base (341)..(341): a, c, t, g, unknown or other
  misc_feature (341)..(341): n is a, c, g, or t
  modified_base (493)..(493): a, c, t, g, unknown or other
  misc_feature (493)..(493): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctccaacatcgggcgtgataatgtgtactggtacaagcaggtcccaggaacgaccgaccaaactcctcatctctcacaatatccagcgccctnaggacgtccctgaccctattctctcgcctcaacgtcccgcacctcacgtccctcccgtcggccatccgaggttcgggccgtcccggggacccgaggggactggacggcttgtatttagttactgtgcgagagtgggaatgacacgttgggtntcgttattcttcgtcggccgtcgggacctacggttcctaaccgttccgttcgg

SEQ ID NO: 330138 - DNA, 491 bp, Homo sapiens
  misc_feature: GZ8MTXP01EFA0Z.2.76.G10.1.454.CMB.2.raw
  modified_base (409)..(409): a, c, t, g, unknown or other
  misc_feature (409)..(409): n is a, c, g, or t
  modified_base (477)..(477): a, c, t, g, unknown or other
  misc_feature (477)..(477): n is a, c, g, or t
  modified_base (479)..(491): a, c, t, g, unknown or other
  misc_feature (479)..(491): n is a, c, g, or t
tcagacgctcgacacacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtcccctgaccgattctctgcctccaagtctggcacgtcagccttcctggacatccgtggcctccagtctgcgatgagctgtttatttctgttcagcacgggatgccagcccggaatggacaagttgggtattcgggcggaggggaccaagttgaccgtctaagtcagcccaaggcccncccctcggtcactctcgttcccaccctcctctcgtcgacgcgtctgacgcgggctggcaaggcgcaangnnnnnnnnnnnnn

SEQ ID NO: 330139 - DNA, 627 bp, Homo sapiens
  misc_feature: GZ8MTXP01DFOSH.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctccaacatcgggcgtgataatgtgtactggtacgaagcgacggtacccgaacggaaccgaacccccaaacctacctcactctctacacaataatacacgaccggcctcacggacgtaccctcgccgtacttcctctcgccctccgacgtccggccacctccacgccctccctggccatcaggcgggccgtcccgggacggacggagttcggacgggtctaggtaatttacgttacgtggtcgacgtagggagtggggtaataacgaaccgttaaccggttggggttgttactttgttacccgtttccggtttaccgggaacccggtagggtaacccgtaaacgggtccgttacccgtttccgtttggggtaacccg

SEQ ID NO: 330140 - DNA, 741 bp, Homo sapiens
  misc_feature: GZ8MTXP01EFTRV.2.76.G10.1.454.CMB.2.raw
  modified_base (228)..(228): a, c, t, g, unknown or other
  misc_feature (228)..(228): n is a, c, g, or t
  modified_base (629)..(629): a, c, t, g, unknown or other
  misc_feature (629)..(629): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcacgccgtccgtcggggtcccccggnaggacgggtccacctattcttcttgttcgtgggacgccaccctaccaacgtacgtccggggcgtaggtaattaagtggttacgtaacgtaggtaacaaggccgaacgggtaccccgaacggaaccccgaacccccctaaactccctacacttcctacctacaactaaagtaactccaaccggcccggtcctacgacgggtaccgtacccccgtacgtaacccgtactttccctccgtccgtaccccgttacccgaacgggttccccggacccttacccgtccgaccgtcccccttcccgtagggacccctagtaccgacggggtccggggtaccccggtccggggaaccggagggtacgtcggggagggttccttaggttaactttagtacgtggtacggngtaaaggggtgtaggggactaacgaaccggttacggttgggttactcgtttacttccgttcgttaccgggcgtacggaaccgtacggtccttacccgttcgttgggaacccc

SEQ ID NO: 330141 - DNA, 551 bp, Homo sapiens
  misc_feature: GZ8MTXP01DMG6Z.2.76.G10.1.454.CMB.2.raw
  modified_base (219)..(219): a, c, t, g, unknown or other
  misc_feature (219)..(219): n is a, c, g, or t
  modified_base (485)..(485): a, c, t, g, unknown or other
  misc_feature (485)..(485): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagaggtcaccatctcttgtctggagcacctcaacatcgggctgataatgtgtactggtacaagcacgggtccccaaggaacccgaaccccccaaaactccctacattctctacaacaaataaatcacgccggcctgaggactccctgaacccgattcctctcgccctccaaagtcccggcaccctcacgccctccctggacccatccaggtcgggcctccggggaccgaggagtgacggctagattagtacgtgtgcaggatgggntaacgacaccgtgggttgcttattcttcgttccggcgtggaaccaggtccaccgtcgttcggaacc

SEQ ID NO: 330142 - DNA, 584 bp, Homo sapiens
  misc_feature: GZ8MTXP01AHFIM.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggaggcacctccaacagtcgggcgtgataatgtgtactggtacaagcacggtcccaaggaaccgacccccaaactcctcatcctctacacaaataatcacgccggcctcgacggactccctgaaccgtattctctcgccctacgaacgtcccggcaccgtcacgccctcctggcccatcgaggtcgggcctcccggggacgacgggacgtggagggtctaggtattacgttacgtgtgcgtaggagtgggatcgaacttaccggtggttcgtcttaagttccgttccgttccggaaccggtgggaacctaacgggtccgttaccgtccgtttcgaacccgg

SEQ ID NO: 330143 - DNA, 609 bp, Homo sapiens
  misc_feature: GZ8MTXP01DXHZE.2.76.G10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggaggtcaccatctcttgtcnggagcactcanatcggcgtgatatgtgtactggtacaagcacggtacccaaggaacccgaacccccaaactcctcactcnctcaacaaatatcacgccggcctcagacgtccctgcgattcnctcgcctcacgtcccgcacctcacgccctccctggcccatcgaggtcggggcctacccggggaccgngggaacttgggaagggccttagggactttaacttacgtggtacggacaagggtagttgggggataacgaaccgttaaaccgttgggggttactccgttttaattccgttccgttacggggtaacccgtaggggaacctaaacggggtccaccccggtttccgtttaacggggaaccc

SEQ ID NO: 330144 - DNA, 686 bp, Homo sapiens
  misc_feature: GZ8MTXP01CQWG5.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccgggnagagggtcaccatctcttgttctggagcacctcaacatcgggctgataatgtgtactggtacaagcacggtccccaaggaacccacccccaaactcctacactcctctacaacaaataactcacgccggcctgacggactccctgaacccgattcctctcgccctaccgaacgtcccgctaccctcacgtcccctcccgtggacctacgttccgacgggtcgggcccgtcccgggggaccgaaggggtacgtcggaacggggtccttagggtaattttacgttaccgtggttacggacgtaaggggtacgttgggggaacttaacgggtaaaccgttaacccgggtttgggggttcttaccgttttaacgttcccgtttccggtttaccgggtaaccccggttacgggggaaccccttaaaggggttccccttaaccccgggtttccgtttcggggtaaccccg

SEQ ID NO: 330145 - DNA, 585 bp, Homo sapiens
  misc_feature: GZ8MTXP01DXJET.2.76.G10.1.454.CMB.2.raw
  modified_base (224)..(224): a, c, t, g, unknown or other
  misc_feature (224)..(224): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctccaccctcctcactcactgtgcgagggtcctgggcccagtctgtgctgactcacgccacctcacgcgtcgtcgggtccccggnaggaggtcactatcttcttgttcgtgggacgccaccctccaaacgacgtcgggcgtagaattaagtgtagtacgtggtaacaaggcgacggtaccccgaaggaaccccgaaccccctaaactcctacactctcacaacaataacncgaccgccgcagacgcctccacgctntcnctcnccacacgccncacncaccgcctcgcgacatcgcggcggccgcgggacgngngtgacgtctagtattgtgtgacgngtaggtggtacganaacggtacgttacggttggttcttacgttcttccgttcggttaccggtccggtacggaaccgtacggtcccgttaccggtccgttcggtaaccg

SEQ ID NO: 330146 - DNA, 566 bp, Homo sapiens
  misc_feature: GZ8MTXP01AHPIR.2.76.G10.1.454.CMB.2.raw
  modified_base (220)..(220): a, c, t, g, unknown or other
  misc_feature (220)..(220): n is a, c, g, or t
  modified_base (433)..(433): a, c, t, g, unknown or other
  misc_feature (433)..(433): n is a, c, g, or t
  modified_base (467)..(467): a, c, t, g, unknown or other
  misc_feature (467)..(467): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctccaacatcgggcgtgataatgtgtactggtacaagcaggtccccaggaaccgacccccaaactcctcatctctcacaataatcacgccggcctcgaggacgtcccctgaacccgtattcctctcgccctccaacgtcccggcaccctcacgccctccctggccatcgagtcgggctccggggngaggagtgaggctagattgtacgtgtgcgtaggntgggatggaacttacgtggggttcgtacttattccgttcgttaccgggaaccgttcggggaacctaacgggtcccttacccgttccgttgggtaacccg

SEQ ID NO: 330147 - DNA, 589 bp, Homo sapiens
  misc_feature: GZ8MTXP01AXN8Q.2.76.G10.1.454.CMB.2.raw
  modified_base (219)..(219): a, c, t, g, unknown or other
  misc_feature (219)..(219): n is a, c, g, or t
  modified_base (406)..(406): a, c, t, g, unknown or other
  misc_feature (406)..(406): n is a, c, g, or t
  modified_base (468)..(468): a, c, t, g, unknown or other
  misc_feature (468)..(468): n is a, c, g, or t
  modified_base (511)..(511): a, c, t, g, unknown or other
  misc_feature (511)..(511): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctcacatcgggcgtgatatgtgtactggtacaagcaggtcccaggaaccgacccccaaactcctacactctctacacaatactcacgccggcctgacggtacgtccctgaacccgattcctctcgccctacaacgtcccgctacctcacgcctcccgnggccatcgacggtcgggccgtccgggccgaggtagcggaggtctagtacttgttaacttggncgtaagggagttcggggattcggaaccttaccggttggggttntaccgtttattccgttcgtttaccgggaaccgtggggtaacccaacgggtcccttaccggttccgttcgggtaacccg

SEQ ID NO: 330148 - DNA, 624 bp, Homo sapiens
  misc_feature: GZ8MTXP01DAYGW.2.76.G10.1.454.CMB.2.raw
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggaggtcaccatctcttgttctggagcacctcaacatcgggctgataatgtgtactggtacaagcaggtcccaggaaccgaccccaaatcctcatctctcacaatatcacgccggcctnaggactcccctgccgtattcctctcgccctcaacgtcccgcacctcacgccctcccgtggcccatccgagggtcgggccgtccggggaccgagggagtcggagggtccttaggtactttacgttacgtggttacgcgaagggtagtcggggaattcggtaaacgttaaaccggttggggttcgttaccttttaacgttccgttccggtttacccggggaacccgttaggggtaaccccgtaaacggggttcccttaaccccgggtttccgttcggggtaaccccg

SEQ ID NO: 330149 - DNA, 581 bp, Homo sapiens
  misc_feature: GZ8MTXP01C8AZU.2.76.G10.1.454.CMB.2.raw
  modified_base (221)..(221): a, c, t, g, unknown or other
  misc_feature (221)..(221): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagccgtcgtcgggtccccggnaggagggtcaccatctcttgttctgggaggcacctcaacatcgggcgtgataatgtgtactggtacagcacggtcccaaggaaccacccccaaatccctacactcnctacaacaaatatcacgccggcctnaggctccctgaaccgtatcctctcgcctacgaacgtccgcacctcacgccctcctgaccactcgaggtcggccgtccgggaccgaggacgtggacggtcctagtaactttagtacgtggtcgagtaggtagtgggattaacgaacgttacggtgggcgtacttattccgttcgttccggaacgtacgggtaacctaacgggtccttacccggttcgttcgggtaacccg

SEQ ID NO: 330150 - DNA, 499 bp, Homo sapiens
  misc_feature: GZ8MTXP01AL34S.2.76.G10.1.454.CMB.2.raw
  modified_base (485)..(485): a, c, t, g, unknown or other
  misc_feature (485)..(485): n is a, c, g, or t
  modified_base (487)..(499): a, c, t, g, unknown or other
  misc_feature (487)..(499): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggccccaaactcctcatctataccaatgatgtgcggccctcaggggtccctgaccgattctctgcctccaagtctggcacgtcagccttcctggacatccatggcctccagtctgcggatgaggctgtttatttctgttcagcacgggatgcagcccgaatgggcaagttgggattcgggcggagggaccagttcgaccgtctaagtcagcccaggctcgcccctggcactctcgtccccaccctctctcgtcgacgtcgtctggacggcggggtctcgggcgaagggccgcaagtgngnnnnnnnnnnnnn

SEQ ID NO: 330151 - DNA, 583 bp, Homo sapiens
  misc_feature: GZ8MTXP01DAO9V.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctcacatcgggctgataatgtgtactggtacaagcaggtcccaggaccaccccaaatcctcatctctcacaatatcacgccggcctgacggacgtcccctagaacccgtatttcctctcgccctaccgaagtcccgcaccctcacgtccctccctggccctatcgaggtcgggcctcccggggccgagggcgtggacgggtcttgatttagttacgtggtacgcgaggtagtggggatggaacaacgttggggttctactttacttcgttcgttccgggaacccgttaggggaacccgtaaagggtcccttacccggtttccgttaagggtcccg

SEQ ID NO: 330152 - DNA, 638 bp, Homo sapiens
  misc_feature: GZ8MTXP01D0Y82.2.76.G10.1.454.CMB.2.raw
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
  modified_base (437)..(437): a, c, t, g, unknown or other
  misc_feature (437)..(437): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagccgtctcgggtccccccgggnaggacggtcacctatctcttgttcgtaggacgccacctaccaacgagtcgggcgtagaataagtgtagtacgtaggtaacaagcgacggtacccgaacggaacccaaccccctaaactcctactactctctacaacaaatacacgaccgccgcctagacgcgtacccncgaaccgtactcctctcgccctacgacgtcccgacctacctcgacncctccgtcgaccactacgtacggtcgggccgtccgggaccggacggacgggtacggtacggtacgtacgtaacgttaacgttacgttagtacgacgtaggtaggtaggtagtaacgtaacgaacggtacggttcgtacgttacttcgttcgttacggtaaccgtacggtaacgtaacgtacgttaccgtccgttcgtaacg

SEQ ID NO: 330153 - DNA, 616 bp, Homo sapiens
  misc_feature: GZ8MTXP01D2UE7.2.76.G10.1.454.CMB.2.raw
  modified_base (221)..(221): a, c, t, g, unknown or other
  misc_feature (221)..(221): n is a, c, g, or t
  modified_base (519)..(519): a, c, t, g, unknown or other
  misc_feature (519)..(519): n is a, c, g, or t
  modified_base (553)..(553): a, c, t, g, unknown or other
  misc_feature (553)..(553): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtccccggnagaggtcacatctcttgtctggagcacctcaacagtcgggctgataatgtagtactggtacagcgacggtacccaaggaaccccgaacccccaaactcctacactctctacaacaaatactcacgcccggacctacgacggtaccgtcccctacgaaccgtacttcctactccgtcccctaccgaacgtccccggcctaccctcgaccgccccttaccgtcggacctatcgacgggtcgggcccgtccggggaccgtaggacgtcggacggtctaggtaatttacgtacgtggtacgngtaggagtgggataacgacgttacggttgggttntacgttattccgttcgttaccggccgtaggaaccgtaggtcccttaccgttcgttggaacccg

SEQ ID NO: 330154 - DNA, 638 bp, Homo sapiens
  misc_feature: GZ8MTXP01BE1L2.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgttctggaggcacctccaacatcgggcgtgataatgtgtactggtacaagcaggtccccaggaacccgaccccaaactcctcactctctacacaatatcacgccggcctgaggactcccctgaaccgatttcctctcgccctccgaacgtcccgcacctcacgccctccctggcccatcgacggtcgggccgtccgggaccgaggagtcggaggcttaggtaacttagttacgtgtcggactaaggggtatgggggtaataacggtaaacccgttaaccggttgggggttactaccgttttaacgttccccgtttcggttaccccggggtaaccccggttggggtaacccccgttaaagggggtccccttaaccccgggtttccgtttccgggtaaccccg

SEQ ID NO: 330155 - DNA, 705 bp, Homo sapiens
  misc_feature: GZ8MTXP01CAM03.2.76.G10.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (591)..(591): a, c, t, g, unknown or other
  misc_feature (591)..(591): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagccgtcgtcgggtcccccgggnaggacgggtcaccatctcttgtctggagcacctcaacngtcgggntgataatgtagtactggtaacagcacggtccccaaggaaccccgaacccccctaaatcccctactaacttccctacctaacaaactaaatacctacgacccggccccgtacctagtaccggtacccgtacccgtaccgaaccgttacttcccgtcgtaccccgacccgtaccggtaccgtcccgaccctaccctacgcccgtccccgtccgtcgacctacgtcgtaccgggtccggaccgggtcccgggacggtacggtaggggcggtacgtcgtaggttaacttaacgttcgtggtacgacggtaagggtaggtacggngtaaccgtaaacggttgggtcgggttactttacgttccgttccgtttccggttaaccggtcggttaccgggaaccgttacgggtcccgtttaccggtccgttcggtaaccccgg

SEQ ID NO: 330156 - DNA, 676 bp, Homo sapiens
  misc_feature: GZ8MTXP01BYJB6.2.76.G10.1.454.CMB.2.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctccaacngtcgggctgataatgtgtactggtacaagcgacggtaccccaaggaaccccgaaccccccaaactccctacactcctctacaacaataactcacgccggcctgacggacgtccctagaacccgtattcctctcgccctacgaacgtcccgccacctcacgccctcccgtcggaccctagtccgagggtcgggcccgtacccggggaccgtagggacgttggggaacggtccttaggtaaactttacgttaaccgtggttacggaccgtaagggtagttggggataacggtaacccgttaaaccgggttgggggttaacgttcctttaacgttcccgttccggttacccgggtaacccgttaggggtaacccctaaacggggttccttaaccccggtttccgtttaaggggtaaccccg

SEQ ID NO: 330157 - DNA, 549 bp, Homo sapiens
  misc_feature: GZ8MTXP01EMCML.2.76.G10.1.454.CMB.2.raw
  modified_base (220)..(220): a, c, t, g, unknown or other
  misc_feature (220)..(220): n is a, c, g, or t
  modified_base (405)..(405): a, c, t, g, unknown or other
  misc_feature (405)..(405): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctcaacatcgggctgataatgtgtactggtacaagcaggtcccaggaaccgacccccaaactcctcatctctcaacaataactcacgccggcctcgaggcgtccctgccgtattcctctcgccctaccaacgtcccgctaccctcacgccctcccngcccatcaggtcgggcctccggggaccagggtagtggacgggtccttaggtaatttacttcgtgtcgcgaggatgggatcgacttacgtgggntcttancgttcgttcggaacttgggaacctaggtcaccgttcgttggaacc

SEQ ID NO: 330158 - DNA, 537 bp, Homo sapiens
  misc_feature: GZ8MTXP01B2IFY.2.76.G10.1.454.CMB.2.raw
  modified_base (220)..(220): a, c, t, g, unknown or other
  misc_feature (220)..(220): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctccaacatcgggcgtgataatgtgtactggtacaagcaggtcccaggaaccgacccccaaatcctcatctctcaacaataatcacgccggcctgaggacgtacccctgaacccgattcctctcgccctaccgaacgtcccgcacctcacgccctccctggcccatcaggtggcctccgggcgaggagtggaggctgtacttatcgngtgcagggatggggatggaaccacgtgggntcttattcttcgttcggaactgggaacctaggtcaccgttcgttggtaacc

SEQ ID NO: 330159 - DNA, 586 bp, Homo sapiens
  misc_feature: GZ8MTXP01DE48V.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctccaacatcgggctgataatgtgtactggtacaagcaggtccccaaggaaccgacccccaaatccctcactctctcaacaaataatcacgccggcctgacggacgtcccctagaacccgtatttcctactcgcccctacaaacgtcccggccaaccgtcacgccctcccgtggccatcaggtcggctccgggccgaggagtcggaggtctggtaacttagtacctggtgtccgaggatggggatgaacaaccggttgggttacgtcttagttccgttcgttacccggtaaccgtagggaacccgtaaggtccttacccggttcgttcggtaacccg

SEQ ID NO: 330160 - DNA, 586 bp, Homo sapiens
  misc_feature: GZ8MTXP01BY9HQ.2.76.G10.1.454.CMB.2.raw
  modified_base (220)..(220): a, c, t, g, unknown or other
  misc_feature (220)..(220): n is a, c, g, or t
  modified_base (369)..(369): a, c, t, g, unknown or other
  misc_feature (369)..(369): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctccaacatcgggctgataatgtgtactggtacagcaggtccccaggaaccaccccaaactcctcactctctacaacaataatcacgccggcctagacggcgtcccctgaaccgattccnctcgcctacaagtcccgcaccctcacgccctcccgtggcccatcaggtcgggcctcccgggcgaggatggaggtctggaattagtacgtggtacgctagggactggggtatggaaccttacggtggggttctacgtttacgttccgttcgttaccgggtaaccgtacggggtaaccctaacgggtccgttaaccccgttccgtttcgggtaaccccg

SEQ ID NO: 330161 - DNA, 601 bp, Homo sapiens
  misc_feature: GZ8MTXP01BNBPI.2.76.G10.1.454.CMB.2.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (407)..(407): a, c, t, g, unknown or other
  misc_feature (407)..(407): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggaggaggtcaccatctcttgtctggacggcacctccaacagtcgggctgaataagtgtagtactggtacaagcacggtcccaggaaccacccccaaatcctcatctcncacaatactcacgccggcctanacgacgtcccagaaccgattcctctcgccctcgaacgtcccgcacctcacgccctccnggaccatcagggtcggcccgtccgggaccgaggacgtgggacgtcgtaggtactttattacgtgtggacgtaagggtagtggggtataacggaaccttacgggtgggttcgtacttaacgttccgttccgtttaccgggaacccgtaggggtaacccaagggttcccaccggtttcccgttaacgggtaacccg

SEQ ID NO: 330162 - DNA, 614 bp, Homo sapiens
  misc_feature: GZ8MTXP01DBQFY.2.76.G10.1.454.CMB.2.raw
  modified_base (219)..(219): a, c, t, g, unknown or other
  misc_feature (219)..(219): n is a, c, g, or t
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcgggtccccggnaggaggtcaccatctcttgtctggagcacctcaacatcgggctgataatgtgtactggtacagcacggtccccaggaaccacccccaaactcctcactcnctacaactaaatatcacgccggcctgagactcccngaaccgtattcctctcgccctacaaggtcccgcacctcacgccctcctcggaccagtcaggtcgggcctccggggaccgtaggacgtggaacggtcttagtaactttattacgtggtacgacgagggtagtgggggaataacggaaccgttaaccgggttggggttacgttacctttacgttaccgttccgggtttacccgggaaccgttaggggaacccgtaaagggttcccaacccggtttcgttaacggggtaaccc

SEQ ID NO: 330163 - DNA, 648 bp, Homo sapiens
  misc_feature: GZ8MTXP01DB5VB.2.76.G10.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcggggtcccccggnaggacggtcaccatctcttgttctggagcacctccaanatcggctgataatgtgtactggtacagcacggtacccaaggaacccgacccccaaactcctacacttcctactacaactaaataatccaacgcccggacctcgaaggacctccctagccgtattcctctcgccctaccgaacgtcccgactaccctcgacgccctccgtcggcctacgtcgagggtcgggcctcccggggacgaacgggtagtcgggtaacgggtcttagggtaacttttacgttaccgtgttacggcgaagggtagtagggactaacgggaaaccttaaccgggttgggttacgttactttgttaccggttcgttaccgggaacccgttaggggaacctaacggggtcccttaaccggttccgttcgggtaacccg

SEQ ID NO: 330164 - DNA, 582 bp, Homo sapiens
  misc_feature: GZ8MTXP01EUKQ5.2.76.G10.1.454.CMB.2.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (480)..(480): a, c, t, g, unknown or other
  misc_feature (480)..(480): n is a, c, g, or t
tcagacgctcgacacacgaccggtgctcgatttagtcactcatacaggggggagagatctgggggaagctcagcttcagctgtggtagagaagacaggattcaggacagtctccaacatggccggcttccctctcctcctcaccctcctcactcactgtgcagggtcctgggcccagtctgtgctgactcagccaccctcagcgtctcgggtcccccgggnagaggtcaccatctcttgttctggagcacctccaacntcgggctgataatgtgtactggtacaagcaggtccccaggaaccgacccccaaatcctcatcctctcacaaataancagccccgccctnaggactcccctagacccgntttcctctcgccctaccaaggtcccgcaccctcacgtccctccctggccctaatcaggtcggggcctcccggggcgagggatggggacggtctgtattattacgtgtgcaggtntggggatggaactaaccgttggggtcttcgttatcttacgttccggaccgttcgggggacctaacggggttccaccggttccgttcgggttaaccaacccgg

SEQ ID NO: 330165 - DNA, 654 bp, Homo sapiens
  misc_feature: GZ8MTXP01D1D0F.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcagccaccctcagcgtctcgggtcccccggnagaggtcaccatctctgtctggagcacctcaacatcgggctgataatgtgtactggtacagcacggtcccaggaaccgacccccaaactcctcactctctcacaatatcacgcggcctgacggacgtccctgccgtattcctctcgccctacacgtcccgcacctcacgccctccctcggcctatccgaggtcgggccgtcccgggggacccgagggtacgtcgggacgggtccgttaggtaacttttagttaaccgttgggttacggccgtaaaggggtgttacggggggattaacggtaaacccggttaaacccggttggggggttccgttctttaacgttccgtttccggtttaccgggaaccccggttacgggggaaccctaaacgggggttcccttaaccccggtttcccggtttaacgggtccccgg

SEQ ID NO: 330166 - DNA, 665 bp, Homo sapiens
  misc_feature: GZ8MTXP01C1OWI.2.76.G10.1.454.CMB.2.raw
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (472)..(472): a, c, t, g, unknown or other
  misc_feature (472)..(472): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctccacctcctcactcactgtgcagggtcctgggcccagtctgtgctgactcagccaccctcagcgtcgtcgggtcccccggnaggaggtcaccatctcttgttctggagcacctcaacagtcggctgataatgtgtactggtacaagcacggtaccccaaggaacccgaacccccaaatccctacaacttccnctacaaactaaataatccaacgccggtacctacgaacggaccgttcccctagtaacccgtatttccctcgtcgaccctaccgaaacggtccccgactaccctcaccgtccctcccgtggacccagtcgaggtcgggcccnccggggacgaggagtcgggaaggtcctagaatttacgtacgtggtacgcgtaagggtacgtggggaactaacggaaaccttaaccgggttggggacgttactttaacgttccgtttccggttacccgggtaacccgttacggggtaaccctaacggggttcccttacccggtttcccgttaacgggtaacccg

SEQ ID NO: 330167 - DNA, 569 bp, Homo sapiens
  misc_feature: GZ8MTXP01COWR6.2.76.G10.1.454.CMB.2.raw
  modified_base (218)..(218): a, c, t, g, unknown or other
  misc_feature (218)..(218): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagaggtcaccatctcttgttctggaggcacctcaacatcgggcgtgataatgtgtactggtacaagcaggtccccaggaaccgacccccaaactcctcactctctcaacaataancacgcggcctnaggctccctgccgattccnctgccctaccgaagtcccggcaccctcacgtccctccctggccctagtccaggtcggctccgggcgtaggatggaggctagtatttagtactgtcgcgtggagtggggattcggaaccgttaaaccgtggggttctaccgtttattcccgttcgttaccggaacgttcgggaaccaagggttccacccggttccgttgggtaaccc

SEQ ID NO: 330168 - DNA, 644 bp, Homo sapiens
  misc_feature: GZ8MTXP01DEJ4S.2.76.G10.1.454.CMB.2.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtccgtcggggtcccccggnaggaggtcaccatcttcttgttctgggacgcacctcaacngtcgggctgataatgtgtacgtggtacaagcacggtcccaaggaaccccgaacccccaaactcctcactcctctacaactaaatatcacgccggcctgacggacgtccctgccgtatcctctcgccctcgaacgtcccgcaccctcgacgtccctccgtggaccctagtcgacgggtcggcccgtcccggggacgtagggacgttcgggaacgggtccttaggtaaacttttacgttaaccgttggttacggacgtaagggtaggtgggtaataacggaaccgttaccggttggggttcttacgtttacttccgttccggttaccggtccgttaaggggaaccctaaacggtcccgttaccggttccgttcggtaacccg

SEQ ID NO: 330169 - DNA, 631 bp, Homo sapiens
  misc_feature: GZ8MTXP01CPC58.2.76.G10.1.454.CMB.2.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcacatctcttgtctggngcacctcacatcggctgataatgtgtacnggtacagcacggtcccaggaaccacccccaaatccncatcnctacacaaatatcacgccggcctgacggacgtcccctgaacccgtatttccctctcgccctaccgaacgtccccggaccaccctccaccgtccctcccgtcggcctacgtcacgggtcgggccgtcccgggaccgaggacggtggacggtccttaggtaactttaagttaccgttggtgacgtaagggagttgggagttaacgaaccgttaaccggttgggttacgtcgtttaacgttccgttccggttaccgggtaacccggtacgggtaacccgtaacggtcccgttaacccggtttcccgttaacgggtaacccg

SEQ ID NO: 330170 - DNA, 725 bp, Homo sapiens
  misc_feature: GZ8MTXP01C6YB1.2.76.G10.1.454.CMB.2.raw
  modified_base (224)..(224): a, c, t, g, unknown or other
  misc_feature (224)..(224): n is a, c, g, or t
  modified_base (405)..(405): a, c, t, g, unknown or other
  misc_feature (405)..(405): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtactgggcccagtctgtgctgactcacgcccacctcagcgtcgtcggggtcccccggnaggacgggtcaccatctcttgttcgtggacggcaccctccaacagtcgggcgtagataatgtgtactggtaacaagcgacggtcccaaggaacccgacccccaaactcctacacttcctctacaacctaaataactcaacccgccggtacctacgacggtaccgtaccctacgaacccgtnttcctccttcgcccctaccgaaacggtccccgactacccctcaccgtcccgtcccgttccggaccctaaccgttaccgtacggttaccgggcccggtcccggggacccgggtaacggacggggtaggtaacgggtccggttacggttaatttaacgtttaaccgttcggtaggtaccggtaggtacggtacgggtaggttaacggaacggttaaccggttaagggttcggttacgttacgttccgttcggttaccggtaaccggtaccgggtaaccggtaaccggtaccgttacccggttccgttccggttaaccccggg

SEQ ID NO: 330171 - DNA, 697 bp, Homo sapiens
  misc_feature: GZ8MTXP01A0NL0.2.76.G10.1.454.CMB.2.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcggggtcccccggnaggacgggtcaccatctcttgttcgtggacggcacctccaacngtcgggctgataatgtgtactggtacagcacggtcccaggaacccgaccccccaaactcctacacttctctacaacaatactcgacgccggtacctcgaggaccgtacccctcgaacccgtacttcctctcgtccctacccgaacgtccccggacctaccctccgaccgtcccctcccgtcgggacccctacgtccggacgggtcggggtcccggtcccggggacccgggaagggacggtcgggtaacggtccttaggttaactttacgttacgtggtcgggacgtagggtcgtagggggataacggtaacgttaccgggttggggttacgttacctttacgttcccgtttcggttacccggggtaaccggtccggggtaaacccgtaacgggtcccgttaacccgggtttcccgttaacgggtaaccccg

SEQ ID NO: 330172 - DNA, 577 bp, Homo sapiens
  misc_feature: GZ8MTXP01EMPZW.2.76.G10.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgttctggagcacctcaacntcgggctgataatgtgtactggtacaagcaggtcccaggaaccgcccccaaactcctcatctctcacaatancacgccggcctnaggactccctgccgtatcnctgcccttcgaagtcccgcacctcacgccctcctggcccatcgagtcgggcctccgggccgaggacgtgaggtctaggactttattacgtggtcgcgagggatggggaatcggaacttaaccggttggggttacgtcctttaagcccgtttcgttacccgggtaaccgttggggaaccctaaacgggtcccgacccggttccgtttcgggtaaccccg

SEQ ID NO: 330173 - DNA, 657 bp, Homo sapiens
  misc_feature: GZ8MTXP01ECA8B.2.76.G10.1.454.CMB.2.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (514)..(514): a, c, t, g, unknown or other
  misc_feature (514)..(514): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctnagcgtcgtcgggtccccggnaggaggtcacatctcttgttctggagcacctcaacagtcgggcgtgattaatgtgtactggtaacaagcacggtccccaaggaaccccaacccccaaactcctacaacttcctactacaactaaataactccgaacgcccggacctacgacggaccgttcccctagaacccgtactttccgtccgtccgcccttaccgaacggtcccgacctaccctcaccgtcccctcccgtcggaccctacgttccgagggtccgggcccgtcccggggacgaaggtagtagggaccggtnttaggtactttaacgtcgtggtacgagaggtagtggggactaaggtaaccacgggttgggttactcgtttacttccgttcgttaccgggaaccgttacgggaacccgttacgggtcccttaacccggttcgttcggaaccccg

SEQ ID NO: 330174 - DNA, 573 bp, Homo sapiens
  misc_feature: GZ8MTXP01CF1QS.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctcaacatcgggctgataatgtgtactggtacagcaggtcccaggaaccgacccccaaactcctcatctctcacaataatcacgccggcctgaggacgtcccctgaacccgattcctctcgccctccaaagtcccggcaccctcacgccctcccgtggcccatcgacggtcgggcctccgggccgaggagtgaggtctagtatttatacgtgtgcgaggtagtggggatggaacgttaccgtggggttctactttattccgttcgttaccgggaaccgttacggggaaccctaaagggtcccttaccggttccgttcggtaacccg

SEQ ID NO: 330175 - DNA, 665 bp, Homo sapiens
  misc_feature: GZ8MTXP01EJ6UW.2.76.G10.1.454.CMB.2.raw
  modified_base (225)..(225): a, c, t, g, unknown or other
  misc_feature (225)..(225): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcagggtcctgggcccagtctgtgctgactcacgcccaccctcagcgtcgtcgggtcccccggnaggaggtcaccatctcttgtctggagcacctcaacagtcgggctagaataagtgtagtacgtggtaacaagcgacggtaccccaacggaaaccccaaccccctaaactccctacaacttcctacctacaaactaaataaactcaaccggcccggtacctagacgggaccttacccctacggaaccctatttccctccttcgacccctaccgtaaacggtccccgaccacccttccgaccgtcccctcccggtgacccctagtccgacgggtcgggaccccgtccggggaccgagggtacgtgggacggtctaagtatttacgtacgtggtacgagtaggtagttgggaactaacggtaacgttaccgggttggttacgtactttacttcgttcggttaccggaagtcgggaacctacggtccacgttcgttaacgaaccg

SEQ ID NO: 330176 - DNA, 750 bp, Homo sapiens
  misc_feature: GZ8MTXP01D9UH5.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcggggtcccccggnaggaggtcacatctcttgtctggacgcacctcaacagtcgggctgattaatgtgtactggtacagcaggtccccaaggaacccaacccccaaatcctcactcctctacaactaaataaatccgaacgcccgggtaccctacggaacggtacccgttaccccctagggaacccgtacttttccctccgttccgtaccccccttaacccgaaacgggtcccccggaccctacccgtacccaccggtccccctcccgttcggacccctaagttccgacggggttccgggggaccccgttcccgggggacccggtaaagggtacggttacggggaacggggtcctttaagggtaacttttagttaaccgttggttacggacgtaaggggtagttgggggaattaacgggaaccttaaccgggttgggggttacgttacttttaacgttcccgtttccggttaccggggaacccggttcggggaacccgttaaacgggtccccttaacccggtttcccgtttgggaaccccg

SEQ ID NO: 330177 - DNA, 666 bp, Homo sapiens
  misc_feature: GZ8MTXP01CT5M5.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtccccggnagaggtcaccatctcttgttcgtggacgcacctcaacagtcgggctgataagtgtgtactggtaacaagcgacggtcccaaggaacccaacccccaaactcctacactctctacaactaaatactcacgccggcctgacgacgtccctagaaccgtatttctacgtcgccctaccgaacggtcccgactaccctcacgtcccctccctcggaccacgtccgacggtcgggccgtccggggaccgaagggtcgtacggtacgggtctaggttaaactttcgttacgtggttacggcgtaaggggacgttggggtaacttaacggaaacccgttaccgggttgggggttcgttaccggttttaacttcccggttccggtttacccgggaaccgggttcgggtaacccgtaacggttccgttaacccgtttccggttaacggtaacccg

SEQ ID NO: 330178 - DNA, 714 bp, Homo sapiens
  misc_feature: GZ8MTXP01EEJLO.2.76.G10.1.454.CMB.2.raw
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnagaggtcacatctcttgtctggacgcacctcaacngtcgggctgataagtgtgtactggtaacaagcacggtaccccaagggaaccccaaccccctaaatccctcacttcctactacaacaaataactcaaccgccggtaccctagacggtaccttacccccgtagaacccgttactttcccttcgtccggaccccttaccgaaaccgggttccccggaccctacccttccgacccgtccccttcccgcgggacccctagttccgacgggtcgggcccgtccggggaccgagggtacgtcggggtaagggtccttaaggttaactttaacgttccgtggtacggacgaagggtacgttggggaactaaggaacccgttaaccggtggggttacgtacctttaagttccgtttccggttaccgggaaccggttacgggaacccgttaaacgggttcccgttaaccggtttcccggtttaacgggtaaccccg

SEQ ID NO: 330179 - DNA, 704 bp, Homo sapiens
  misc_feature: GZ8MTXP01CMREH.2.76.G10.1.454.CMB.2.raw
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtcgtcgggtcccccggnaggagggtcaccatctcttgttcgtggacggcaccctaccaacagtcgggcgtgaataatgtgtacgtggtaacaagcgacggtaccccgaaggaaccccgaacccccaaactccctacacttccncctacaactaaataatccaacggccgacctcgaggaccgtacccgtagaacccgtattcctactccgccctacgtaacgtcccgacctaccctccgacgcccctcccgtggaccctaacgttcgaccgggttcggggccgtaaccccgggggccgtagggtagttcgggaacggtcctacggtaatttagttaccgtggtacgacgaagggtacgttaggggaactcggtaaaccacgggttggggcgttactttaaccgttccgttcccgggtttaaccggggaaccgttaaccgggggaaccctaaacgggggtttccccaaacccggtttcccggtttaagggtaacccccg

SEQ ID NO: 330180 - DNA, 650 bp, Homo sapiens
  misc_feature: GZ8MTXP01BH0NZ.2.76.G10.1.454.CMB.2.raw
  modified_base (228)..(228): a, c, t, g, unknown or other
  misc_feature (228)..(228): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcacgccgtcgtcggggtccccccgggnaggacgggtcaccatctcttgttctggaggcaccctccaacagtcgggcgtgaataatgtgtacgtggtaacaagcacggtccccaaggaaccccgaacccccaaactccctacaactctactacaactaataatcacgccggcctcgaggactccctagaaccgtacttcgtcctcgaccctaccgaaacgtcccgacctacccgtcaccgtccctcccgtggaccctacgtcgacggttcgggaccgtccggggacgacggatgggaacggtctaggtattacgttacgtggtacgcgaggtacgtgggacgtggaaacccgttaccggttgggttactcgtttaacttccgttcgttaccgggaaccgttcggggaaccttaacgggtcccgttaacccgttccggtttcggaaccccg

SEQ ID NO: 330181 - DNA, 695 bp, Homo sapiens
  misc_feature: GZ8MTXP01D6QPG.2.76.G10.1.454.CMB.2.raw
  modified_base (229)..(229): a, c, t, g, unknown or other
  misc_feature (229)..(229): n is a, c, g, or t
  modified_base (549)..(549): a, c, t, g, unknown or other
  misc_feature (549)..(549): n is a, c, g, or t
  modified_base (582)..(582): a, c, t, g, unknown or other
  misc_feature (582)..(582): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgcccaccctcacgccgtcgtccggggtcccccgggnaggacgggtcacctattccttcttgttcgtggacggccaccctaccaacagtcgggcgtagattaagtgtagtacgtggtacaagcgacggtacccgaacggaaccccgaacccccaaactccctacactcctcacaactaaataaactccacgcccggtacctacgacgggtaccgttaccccagtaacccgtatttcccgtccctcggtacccctaccgtaaacgggtccccgacctaccgttaccaccggccccttcccgtcggtacccactccgacgggtcgggacccgtccggggacgtacgaggtcgggacgtntagtaattgttacgtgtgacgtaggagtcgggngtaacgaccgttaacgggttggggttcttacgtttaacgttccgtttccggttaccgggtaaccgtacgggtaacccgtacggtcccgaccggtttccggttcggtaacccgg

SEQ ID NO: 330182 - DNA, 715 bp, Homo sapiens
  misc_feature: GZ8MTXP01AQFLU.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagccgtcgtcggggtcccccggnaggacgggtcaccatcttcttgttcgtgggacggccaccctaccaacagtcggggcgtagattaagtgtagtacgtggtacaagcacggtccccaacggaacccaccccaaactccctcatcctctacaactaaagtaactccgaccgcccggtcctacgaacgggtccgtccccgtgaacccgtactttccgtcgttccgaccccttacccgaacggttccccgggaccctaacccgttcccgaaccgtcccccgttacccgttcgggacccctagttaccggacgggttcccggggcccgttcccgggggaccgtagggaaccgggttgggacgggtcctaggttaaactttagtttaccgaggttcggacgtagggtaggttacggggaacttcggaaccgttaccggtggggttacttcgttacgttccgttcgttaccggtaacgtcgggaaccttaacgggcccttacgttcccgttggtaacccg

SEQ ID NO: 330183 - DNA, 678 bp, Homo sapiens
  misc_feature: GZ8MTXP01A6Y9Z.2.76.G10.1.454.CMB.2.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnagaggtcaccatctcttgtctggagcacctccaacagtcgggctgataatgtgtacnggtacaagcacggtccccaaggaaccgaacccccaaactcctcaactctctacaacaaataactcaccggccggccctagacgggtacgtcccctaggaacccgtatttcccgtccgtccgtacccctacccgaaacggttccccgacctaaccctccgacgtcccctcccgtggcccctatccgacgggtcgggccgtacccgggggaccgtaagggacgttcgggacgggtaccttagggtaatttaacgttcccgttgggtacggtacaagggggtaacgtggggtaataacgaacccgttaacgggttggggttaactcgtttacgttccgttcggtttacccggaaccggttacgggaaccctaagggtcccttaccggttcgttcggaacccg

SEQ ID NO: 330184 - DNA, 676 bp, Homo sapiens
  misc_feature: GZ8MTXP01DPU71.2.76.G10.1.454.CMB.2.raw
  modified_base (228)..(228): a, c, t, g, unknown or other
  misc_feature (228)..(228): n is a, c, g, or t
  modified_base (354)..(354): a, c, t, g, unknown or other
  misc_feature (354)..(354): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgcccaccctcagccgtcgtcggggtcccccgggnaggacgggtccacctatccttctttgttctgggacggcctaccttacaacgagtcgggcgtgaataagtgtgtacgtggtaacaagcacggtaccccaaggaaccccaaccccctaaactccctanacttctctacaactaaatactcacgcccggcctcgacggtaccgtccctagaacccgtactttcctccgttcgaccccctacgtaacggtccccgtacctacccgtaccaccgtccccttcccgtggaccctacgtcgtacgggtcgggacccgtccggggacgtacgggtagtacgggacggtcttagtatttacgttacgtgtagcgtaggtgtggggactaacggaacgttacggtgggttctacgttagttcccgttcggttacccggaaccggtaggggtaaccgtacgggtccttacccggttcgttcggaacccg

SEQ ID NO: 330185 - DNA, 624 bp, Homo sapiens
  misc_feature: GZ8MTXP01D0BZB.2.76.G10.1.454.CMB.2.raw
  modified_base (222)..(222): a, c, t, g, unknown or other
  misc_feature (222)..(222): n is a, c, g, or t
  modified_base (322)..(322): a, c, t, g, unknown or other
  misc_feature (322)..(322): n is a, c, g, or t
  modified_base (444)..(444): a, c, t, g, unknown or other
  misc_feature (444)..(444): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnagaggtcaccatctcttgtctggagcacctcaacagtcgggctgataatgtgtactggtacaagcgacggtcccaggaacccgaacccccaaatccctanactctactacaactaaataaactccgacgcccggaccctacgacggtaccgttccccctggaacccgtattccctactccgaccccttacgaacggtcccgctaccctcacgcccttcccgnggcccaagtcgaggtcgggccgccggggaccgaggtacgtaggacgggtaccttaggtaatttacttacgtggtacgcgtagggtagcggggataacggaacttacggttggggttactctttacttcgttcgttaccggtaaccgtaggccgtaacggtccaccgtttccgttgtcccg

SEQ ID NO: 330186 - DNA, 602 bp, Homo sapiens
  misc_feature: GZ8MTXP01B2X64.2.76.G10.1.454.CMB.2.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtctcgggtccccggnagnggtcacatctnttgtctggagcacctcaacngtcgggctgataatgtgtactggtacagcacggtcccaaggaaccacccccaaatcctnactctctacacaaatactcacgccggcctgacggtactcccctaggaacccgtattccgtctcgcccttacgaaacgtcccgcacctccacgcccctccgtggaccctatcgaggtcgggccgtccgggcgagacgtggacggtctaggtaatttagtaccgtggtacgcgtaagggaattggggaataacggaaccttaacggtggggttcgtacctttagttccgttccggttaccggaaccgttcggggaacctaacggtcccgacccggttccgttgggtaacccg

SEQ ID NO: 330187 - DNA, 792 bp, Homo sapiens
  misc_feature: GZ8MTXP01EN9GC.2.76.G10.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
tcagacgctcgacacacgaccggtgctcgatttagtcactcatacagggggggagagatctgggggaagctcagcttcagctgtggtagagaagacaggattcaggacagtctccagcatggccgcttccctctcctcctcaccctcctcactcactgtgcagggtcctgggcccagtctgtgctgactcacgcccaccctcagcgtcgtcgggtccccggnagaggtcacntctcttgtctggacgcacctcaacngtcgggntgataagtgtagtacgtaggtaacacgcgtacggtaccccaaaggaaaccccgaaccccctaaactccctacacttcctacctacaaactaaacttaaacnccaaaccggtccccggtacctcggaaacgggtacccgttaacccccgttacggtaacccgttaccgttttccctcccgttacccgggtaccccctttaacccgggaaaccgggttccccgggaccctaaaccccgttccgaaccccggtccccccttcccgttaccgggaacccctaaggttcccgacggggttccggggccccgtaccccgggggtaacccggaagggtacggttagggaccggggttaccttacgggttaaattttaacgttaccgtggtacggacgtaagggtacgtaagggggtctaacggtaacccgttaacggggttgggttcgttacctttacgcgtttcccggttaccggggtaaccgtaggggtaaccctaacggggtcccgttacccggttcggttccggtaacccg

SEQ ID NO: 330188 - DNA, 602 bp, Homo sapiens
  misc_feature: GZ8MTXP01EO0YL.2.76.G10.1.454.CMB.2.raw
  modified_base (220)..(220): a, c, t, g, unknown or other
  misc_feature (220)..(220): n is a, c, g, or t
  modified_base (309)..(309): a, c, t, g, unknown or other
  misc_feature (309)..(309): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctcaacatcgggctgataatgtgtactggtacagcaggtcccaggaaccaccccaaatccncatctctacacaataatcacgccggcctgaggacgtccctgaacccgtattctctcgccctacgaagtcccgcacctcacgtccctccctggacccatcgagggtcgggccgtccggggacgagggactggacggtctaggtaatttaactcgtggtacgcgaaggtagtggggaattcgaaaccgttaaccgggtggggttcgtactttaacgttccgttccggtttacccggaaccgttcgggggaaaccctaacggggtcccaacccggtttccgtttcggggtaacccg

SEQ ID NO: 330189 - DNA, 640 bp, Homo sapiens
  misc_feature: GZ8MTXP01CILWG.2.76.G10.1.454.CMB.2.raw
  modified_base (223)..(223): a, c, t, g, unknown or other
  misc_feature (223)..(223): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtccccccgggnaggagggtcaccatctcttgttctggagcacctcaacatcgggcgtgatatgtgtactggtacagcacggtcccaggaaccacccccaaatcctcatctctcacaatatcacgcgctnagctccctgccgattcnctcgcctaccgaacgtcccgcaccctcgacgtccctcccgtggcccagtccgagggttcgggcccgttcccgggggaccgagggtacggtcgggaacgggtccttaggtaacgtttaacgttccgtggttcggacgtaggggtacggtaggggagtaacggtaaccgttaaaccgggttggggttcgtacctttaagttcccgttccgttaccggggtaaccccgtacggggaacccgttaacgggttcccgttaacccggtttcccgttcgggtaaccccg

SEQ ID NO: 330190 - DNA, 626 bp, Homo sapiens
  misc_feature: GZ8MTXP01BY6A1.2.76.G10.1.454.CMB.2.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgcccaccctcagccgtcgtcggggtcccccggnagacgggtcaccatctnttgttctggacgcacctccaacagtcgggctgaataatgtgtactggtaacagcaggtccccaaggaacccacccccaaatccctnactctctacaacaaatactcgaccgccgtcctacgaggactccccgtagaacccgtattcctctcgtccctaccgaacgtcccgccaccctcacgccctcccgtggaccctagtccagggtcggccgtcccggggacgacggagtacgggaggtctacggtatttagttaccgtggtgcgtaggggtagtagggaataacggaacgttaaaccgggtgggttctacttacttcgttccgttaccggaaccgtacgggaacgtaaccgtccgttacccgttccgttaacggtaacccg

SEQ ID NO: 330191 - DNA, 702 bp, Homo sapiens
  misc_feature: GZ8MTXP01DUSRH.2.76.G10.1.454.CMB.2.raw
  modified_base (223)..(223): a, c, t, g, unknown or other
  misc_feature (223)..(223): n is a, c, g, or t
  modified_base (554)..(554): a, c, t, g, unknown or other
  misc_feature (554)..(554): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtcgtcgggtcccccggnaggagggtcacatctcttgttctggagcacctcaacagtcgggcgtagataatgtgtactggtacagcacggtccccaaggaaccccgaacccccaaactccctacacttcctctacaaactaaataaactccgaacgcccggtacctacgaacggaccgttccccctaggaacccgtactttccctctccgaccctaccgaaacggtcccgacctaccctccaccggtccccttcccgtcggaccctagtaccgacggggtccggggcccgtccccgggggaccggtagggacgttcgggacgggtccttaggtaaactttcgtttacgnggttagcgtaagggtagtggggaactaacggtaaacccgttaacggttggggttcttaccgtttagttccgtttccggttacccggggtaaccgtacgggtaacccgttaacgggtcccgttaaccgtttccgttaagggtaaccccg

SEQ ID NO: 330192 - DNA, 579 bp, Homo sapiens
  misc_feature: GZ8MTXP01EJGGK.2.76.G10.1.454.CMB.2.raw
  modified_base (218)..(218): a, c, t, g, unknown or other
  misc_feature (218)..(218): n is a, c, g, or t
  modified_base (481)..(481): a, c, t, g, unknown or other
  misc_feature (481)..(481): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgtctggagcacctcaacagtcgggcgtgataatgtgtactggtacaagcaggtccccaaggaaccacccccaaatcctcactctctcacaataaatcaacgccggacctcgaggacgtcccctgaacccgtatttcctccttgacccctcaaagtccccggcaaccctcacgtccctcccgtggccctatcgaggtcgggccgtccgggcgaggagtgaggctagattattacgtgtgcgtaggntggggatcggaacttaccgtggggttcgtctttaacgttcgttcgttaccggaaccgtggggaaccctagggcccttaccggttccgttgggtaaccc

SEQ ID NO: 330193 - DNA, 610 bp, Homo sapiens
  misc_feature: GZ8MTXP01ANJZM.2.76.G10.1.454.CMB.2.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (543)..(543): a, c, t, g, unknown or other
  misc_feature (543)..(543): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcacgcccaccctcagcgtccgtcgggtccccggnagaggtcaccntctnttgtcnggagcacctcaangtcggctgatatgtgtactggtacagcacggtcccaggaacccaccccaaactcctanactctcacaacaatactcacgccgcctcgacggactccctagaaccgtnttcctctcgtccctacaacgtcccgccacctcacgcccgttccngacctnttcgacggttccgggcctcccggggccgaaggacgttcggacggtctaggttaactttagtccgtggtcgactaaggggtacgttaggggacttaacgaacccgttacgggttgggttacgtactttacncgtttcggttaccgggaacgttacgggaaccgtaagggttcccaaccgtttccgttcgggtaacccg

SEQ ID NO: 330194 - DNA, 633 bp, Homo sapiens
  misc_feature: GZ8MTXP01ESOFI.2.76.G10.1.454.CMB.2.raw
  modified_base (223)..(223): a, c, t, g, unknown or other
  misc_feature (223)..(223): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgccaccctcagcgtcgtcgggtcccccggnagacggtcacatctcttgttctggagcacctccaacagtcgggcgtagataatgtgtacgtggtaacagcacggtaccccaaggaacccacccccaaactccctacactctctacaacaaatactcacgccgcctagacgactcccagaaccgtatttccnctcgccctacacgtcccgactacctcgaccnccctaccgngtacccntacgacggtcggccgtccgggacgaggacgtggacggtctagttaattcgttaacgtggacgtacgagggtagtggggactaacggtaaccgttaacgggttcggggttactaccgtttacgttccgttccggttaccgggtaaccgggtacgggtaacccgtaagggtccccgttaccggttccgtttaacgggtaacccg

SEQ ID NO: 330195 - DNA, 666 bp, Homo sapiens
  misc_feature: GZ8MTXP01CQJ3H.2.76.G10.1.454.CMB.2.raw
  modified_base (218)..(218): a, c, t, g, unknown or other
  misc_feature (218)..(218): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcagccacctcagcgtctcgggtcccccggnagacgggtcaccatctcttgtctggagcacctccaacagtcgggctagattaagtgtgtactggtacagcacggtacccaggaacccgacccccaaatcctacactcctctacaacaataactcaacggccggtaccctgaacgggtactacccctagaaccccgtatttccgtccgtcgacccttaccgaaacggtcccggacctacccgtcaacgtcccttcccgtggacctaatccgacggtcgggccttcccggggcgtaaacggaggttcggacgggtaccttgggtaaactttaacgttccgtggttacgcgtaaagggtgttagggggattaacggaaacgttacccgggttggggttcttaacgtttacgttcgtttcggttaccgggaaccgtggggtaaccctaaggggttcccacccggtttccgttcggtaacccg

SEQ ID NO: 330196 - DNA, 668 bp, Homo sapiens
  misc_feature: GZ8MTXP01A8X96.2.76.G10.1.454.CMB.2.raw
  modified_base (221)..(221): a, c, t, g, unknown or other
  misc_feature (221)..(221): n is a, c, g, or t
  modified_base (648)..(648): a, c, t, g, unknown or other
  misc_feature (648)..(648): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnagaggtcacatctcttgtctggagcacctcaacatcggcgtgataatgtgtacgtggtacaagacacggtaccccgaacggaacccgaacccccgaaacctcctaccaacttcctacctaccaaacaaacttaaactaccgaccgacccggccctacgacggaccgttaccccgtacgaacccggtattcccttcctcggtaccctacccgtaaacggtcccggaccccacccttaccgaaccgccccgttccccgtacgggacccctagtaccgtacgggttcggggcccgttcccggggaccggtaggacggtggaaggtcctagtaactttaatcgtggtgcgaggagtcgggatcggaaccttacggttgggttctacgttattcgttccgttacggtaacccgtgggtaaccaacgggttcncccggttcgttcggaacccg

SEQ ID NO: 330197 - DNA, 713 bp, Homo sapiens
  misc_feature: GZ8MTXP01BC0QH.2.76.G10.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgccaccctcacggcgtccgtcggggtcccccggnacggacggtcacctntcttcttgttcgtgggacgccacctacaacgtgtcgggctagaatagtgtagtactggaacagcgacggtcccaacggaacccaaccccctaaactcctactactcctactacaaacctaaataacgtccgaacggcccggtacctacgacggtaccgtacccctacgaacccgttattcccgtccgtaccgtacccctaccgtaacgggtccccgactaccctcgaccgtccccgtcccgtacggaccctacgtcgtacggggtccgggccgtccggggaccggaggaggttacggaacggttctaaggttactttaacgttccgtaggtacgaggtaagggtagttcggggtaattaacggaacgttaaccgggttgggttacgttactttacgccgtttcggttacgggtaacccggtcgggaaaccgttacgggtcccgttacccggtttccggttcggaacccgg

SEQ ID NO: 330198 - DNA, 672 bp, Homo sapiens
  misc_feature: GZ8MTXP01CHXTN.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggacgggtcaccatctcttgttctggagcacctcaacagtcgggctgataatgtgtactggtacagcgacggtccccaaggaaaccccgaaccccccaaaactccctacaacttcctacctacaacaaataactcacgcccggacctacgacggtactcccctagaacccgtattcctacctcgacccctaccaaacggtccccgactaccctcgacgcccctcccgtggacccctagtccgacgggtcgggcccgttcccggggaccgaggacgtcgggaacggtctaggtatttacgtacgtggtacgagtagggtagtagggtataacggaaccttaaaccgggttggggttactaccgtttagttcccgtttcggttaccgggtaaccggttacgggaacccgtaacggggtcccttaaccggttccgttaacggggtaaccccg

SEQ ID NO: 330199 - DNA, 586 bp, Homo sapiens
  misc_feature: GZ8MTXP01BC1K0.2.76.G10.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
  modified_base (446)..(446): a, c, t, g, unknown or other
  misc_feature (446)..(446): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttntctggagcacctcaacatcgggctgataatgtgtactggtacaagcaggtccccagggaacccaccccaaactccctacactctctaccaacaaataactcgaaccgcggacctnacgggactacccctacgaacttctctcgcctccaacgcggtccacctcacgcctccctcggctactctacggcggcgtccggcccggaagggngtacgggaggtacgtactagttacttacgtacgtgacgaggtagtgggtacgtcgaacgtaacgttcggtgttacgttacgttcgttcgttcgttaccggtaacggacgtaaccgtccgtccgttccgtcgttcgaaccg

SEQ ID NO: 330200 - DNA, 559 bp, Homo sapiens
  misc_feature: GZ8MTXP01D32AT.2.76.G10.1.454.CMB.2.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
  modified_base (497)..(497): a, c, t, g, unknown or other
  misc_feature (497)..(497): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtctcgggtcccccggnagaggtcacatctcttgtctggagcacctcaacatcgggctgataatgtgtactggtacaagcaggtcccaggaaccgaccccaaatcctcatctctcacaataatcacgccggcctnaggacgtcccctgaacccgatttcctctcgccctaccaacgttcccgccacctccacgccctcccnggacccattcgaggtcgggccgtccgggccggagagtgaggcttagacttatactgtgcagggatgggataagaccttacggtggcgtacttncgttcgttccggaacctaggggtaacccaagggttcccacccggttccgtttcggtaacccg

SEQ ID NO: 330201 - DNA, 731 bp, Homo sapiens
  misc_feature: GZ8MTXP01EM9A7.2.76.G10.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
  modified_base (353)..(353): a, c, t, g, unknown or other
  misc_feature (353)..(353): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcggggtcccccggnaggaggtcacctatctcttgttcngggagcacctcaantnncggcgtagtaataagtgtagtacgtacggtaacgaacgacgacggtaccgaacggaaacccgaacccctaaacctacctacactacntaccctacaacaaactaactaccaacggaccggtcccgtaccgaacgggtaccgtcccgtaccgaccgtacttccttccgtaccgtccctaccgtaaccgtaccggacccgtaccctaccgtaccgtccctcccgtccgccgtacctccgtacgggggtcgggtaccgggtcccggggaccgggaacggtacggtacgggtacggtaccgtacgttaacgttaacgttaacgttacgggtaacggtaacggttaacgggtaacgggttacgggtaacggtaacggttaaccgttaaccgggttacgggttcggttaccgtttaaccgttaccgttacccggttacccgggttaacccgggttaaccgggtaacccggg

SEQ ID NO: 330202 - DNA, 634 bp, Homo sapiens
  misc_feature: GZ8MTXP01AY8E7.2.76.G10.1.454.CMB.2.raw
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcacgccaccctcagccgtctcgggtcccccggnagagggtcaccatctcttgtctggagcacctcaacatcgggctgataatgtgtactggtacaagcacggtcccaaggaaccacccccaaactcctacatctctcaactaanactcacgccggcctanacggcgtccctgaaccgatctctcgcctccgaagtcccgcaccgtcacgccctccgtcggaccactcgacggtcgggcccgtcccggggacgtacgggtagtcgggaacggccttaggtaatttacgttaccttgggtacgaccgtaagggacgttgggggaactaacggtaaaccgttaaccggttgggggttcttaccgtttaacgttccgttaccgttccggggtaaccgttacggggaacccgtagggtccccttaccgggttcccgtttcggggtaacccg

SEQ ID NO: 330203 - DNA, 633 bp, Homo sapiens
  misc_feature: GZ8MTXP01B8DV0.2.76.G10.1.454.CMB.2.raw
  modified_base (223)..(223): a, c, t, g, unknown or other
  misc_feature (223)..(223): n is a, c, g, or t
  modified_base (397)..(397): a, c, t, g, unknown or other
  misc_feature (397)..(397): n is a, c, g, or t
  modified_base (563)..(563): a, c, t, g, unknown or other
  misc_feature (563)..(563): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagcgtcgtcgggtcccccggnaggaggtcaccatctcttgttcgtggagcacctaccaacagtcgggctagaataagtgtagtactaggtaacaagcgacggtaccccaacgggaaccccaaccccccaaactcctacacttcctctacaacaaatactcgaccgcccggcctagacggcctacccagaaccgtnttcctctcgccctacgacgtcccgacctacctccgaccgtcccctcccgacggaccctagtccgacgggtccgggcccgtcccggggaccgaggtacgtgggacggtctaggtactttacgtacgtggtgcgtagggagtgggataacgaccgttacggtgggttntacgttcttcgttcggttaccggccggtacggtaaccgtacggtcccttaccggttccgttcggaacccg

SEQ ID NO: 330204 - DNA, 640 bp, Homo sapiens
  misc_feature: GZ8MTXP01DB8IZ.2.76.G10.1.454.CMB.2.raw
  modified_base (220)..(220): a, c, t, g, unknown or other
  misc_feature (220)..(220): n is a, c, g, or t
  modified_base (411)..(411): a, c, t, g, unknown or other
  misc_feature (411)..(411): n is a, c, g, or t
  modified_base (535)..(535): a, c, t, g, unknown or other
  misc_feature (535)..(535): n is a, c, g, or t
  modified_base (573)..(573): a, c, t, g, unknown or other
  misc_feature (573)..(573): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcgggtccccggngagacgggtcaccatcttcttgttcgtggacggccacctaccaacacgtcgggcgtagattaagtgttagtacgtggtaacaagcgacggtaccccaacggaaaccccgaaccccctaaactcctacactcctcctacaacaaatactacgaccgccggacctacgacggtaccgtaccctacgaaccgtnttacctcctcgaccctacccgaacgtcccggacctaccgtccacgtccctcccgtcggacacttcgacggtcgggcccgtccgggacgaggcgtaggacggtctagtatttactacgtgtacgnggtaggtagtagggctaagaaccgttacgggtgggttntactttattccgttcgttaccgggcgtacgggaacctaaggtcccttacggttccgttgggtaaccc

SEQ ID NO: 330205 - DNA, 571 bp, Homo sapiens
  misc_feature: GZ8MTXP01AUZYH.2.76.G10.1.454.CMB.2.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtcgtcgggtcccccggnaggaggtccaccatctcttgtctggagcacctcaacngtcgggctgataatgtagtactggtacaagcacggtcccaaggaacccaccccaactccacatcctctacactaatacncacgccggcctgacgactcccngaacctntcnctcgcctacaacgtcccgacacctcacgcccttccgngccatcgacggtcgggccgtcccgggcgaggngtggacggtctaggtattacgtacgtgtgacgagggtatggggatcgaaccgttacggtgggttacgtcttagttcgttcgttcggaaccgtacggaacctaagggtccttaccggttaacgttgggaacccc

SEQ ID NO: 330206 - DNA, 591 bp, Homo sapiens
  misc_feature: GZ8MTXP01CSCVY.2.76.G10.1.454.CMB.2.raw
  modified_base (220)..(220): a, c, t, g, unknown or other
  misc_feature (220)..(220): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (439)..(439): a, c, t, g, unknown or other
  misc_feature (439)..(439): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccattctgtgctgactcagccaccctcagcgtctcgggtcccccggnagagggtcaccatctcttgtctggagcacctcaacatcgggctgataatgtgtactggtacagcaggtcccaggaaccaccccaactcctcatctcncacaatatcacgccgcctgacggacgtccccngccgtattcctcgtcgccctacgaacgtcccgacctcctcgacgtcccctccgcgccctagtcgacgggtcggcccgtccgggccgaggnggtggaggtctagtacttagttcgtggtcgacgtaggcgtgggataacggaaccgttacgggttgggcttacgtttacttccgttccggtttccgggaaccggtacgggtaacctaacggggtcccttaccggtttccgttcggtaaccccg

SEQ ID NO: 330207 - DNA, 762 bp, Homo sapiens
  misc_feature: GZ8MTXP01C8WLI.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcacctcctcactcactgtgcagggtcctgggcccagtctgtgctgactcacgccaccctcagcgtcgtcgggtccccggnagaggtcacatctcttgttctggacgcaccctacaacagtcgggcgtagataatgtgtacgtggtaacaagcacggtacccaacggaaaccccgaacccccaaactcctacacttcctacctacaaacctaaataactccgaaccggcccggtccctacggaacggtacccgtacccccgttacgaacccggtactttaccctcccgttaccgtacccctacccgtaaaccggttcccccggacctaaccccgttaccgacccggtccccctttcccggtacggacccttaacggttccggacggggttccgggcccgttaccccgggggaacgtacgggtagttacggggagtccgttagtaactttaacgtcgtcggtaagcggtaagggtagtacgggtaattccggaaaacgttccgggtttggggacgtttaaacctttcgtttacccggttcggtttaccccgggaaccgggttaaccggggtaacccgttaacggttccccgttaacccggtttcccggtttaacgggaaccccg

SEQ ID NO: 330208 - DNA, 637 bp, Homo sapiens
  misc_feature: GZ8MTXP01BN7K3.2.76.G10.1.454.CMB.2.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (380)..(380): a, c, t, g, unknown or other
  misc_feature (380)..(380): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtctcgggtcccccggnagaggtcaccatctcttgtctggacgcacctcaacngtcgggctgataatgtgtactggtacagcacggtcccaaggaacccacccccaaatcctcactctcctacaactaataatcacgccggtccctgacggacgtcccctagaacccgtatttcccnctcgccccttaccgaacgtccccggcctaaccctccaccggtcccctcccgtgggacccctaagttccgacgggttcggggcctccgggggaccgaggagtgggacggtctaggtacttagtacgtggtacgcgtaaggtagttagggactaacggtaaccgttaaccgttggggttcgttactttacgttccgttcgttccgggaaccgttcgggaaccgtaacgggtcccttaccgggttccgttcgggaacccg

SEQ ID NO: 330209 - DNA, 733 bp, Homo sapiens
  misc_feature: GZ8MTXP01CDB2A.2.76.G10.1.454.CMB.2.raw
  modified_base (224)..(224): a, c, t, g, unknown or other
  misc_feature (224)..(224): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagcgtcgtcggggtcccccggnaggacgggtccaccatcttcttgttcgtgggacgccaccctccaacagtcgggcgtgaattaagtgtgtaacgtggtaacaagccgtaacgggtaccccgaacggaaaccccgaacccccctaaacttccctactaacttccctacctaccaaactaaacttaacgtaccgaaccggtccccggtacccctacggaaaccgggtacccgttcccccgtacggtaaccccgttactttcccttccgtccgtacccccttacccggaaacgtccccggacctacccgtccaccgtccccctccgtcggaccctacgtccgtcgggtccgggcccgtccggggaccgaggtacggtcggagggtctaggtatttacgtacgttggacgaggtagggtagtcgggactaaggaaccgttacggttgggttcttaccgttacgttccgttccggttaccgggtaaccgtacgggtaaccgtaccggtccgttacccggttccgttcggaacccg

SEQ ID NO: 330210 - DNA, 742 bp, Homo sapiens
  misc_feature: GZ8MTXP01EYPCX.2.76.G10.1.454.CMB.2.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcagggtcctgggcccagtctgtgctgactcacgccaccctnagcgtctcgggtcccccggnaggaggtcacatctnttgtcnggagcacctcaantcggctgatatgtagtactgtacaagcacggtccccaagggaaccccacccccaaaactccctacacttcctctacaacaaataactcgaaccggccggtacctagaacggtaaccgtcccctaggtaacccgtatttcctcctacggtccctaccgaaacggtccccgggacctaaccccgttccaacgtcccccgtccccgttaggacccctaattccgaacggggttccggggacccgtcccgggggaccggtagggtacggtacggggacggggtaccttagttaagtttaacgttaaccgtttggtcgggaaccgaaaggggtacggttagggggaaactccggggtaaaacccgttaacccggggttgggggttaccgttacctttaacggttacccgttcggggtttacccggaaccgggtacgggtaaacccgtaacgggggtcccttacccgggtttaaccgtttcgggaaccccg

SEQ ID NO: 330211 - DNA, 589 bp, Homo sapiens
  misc_feature: GZ8MTXP01D2DMU.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtctcgggtcccccggnagaggtcaccatctcttgtctggacgcacctcaacatcggctgataatgtgtactggtacagcagtcccaggaaccaaccccaaactcctcactctctacaacaataaagtcacggccggacctcgaggtacgtcccctagccgtatttcctctcgccctacgaaacgtcccgcaaccctcacgcccttccgcggacccattccagggtcgggccgtaccgggaccgagggatggaacggtctagtaattattactggtagcgtaggagtggggaatggaaccaaaccggttggggttgtacttacttccgttcgttaccggaacggtacgggaacctaacgggtccttacccggttccgttcggaac

SEQ ID NO: 330212 - DNA, 719 bp, Homo sapiens
  misc_feature: GZ8MTXP01EMBPJ.2.76.G10.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagacgctcgacacacgaccggtgctcgatttagtcactcatacaggggggagagatctgggggaagctcagcttcagctgtggtagagaagacaggattcaggacagtctccagcatggccgcttccctctcctcctcaccctcctcactcactgtgcagggtcctgggcccagtctgtgctgactcacgccaccctcacgcgtcgtcgggtcccccggnaggacggtcaccatctcttgttctggacgcacctcaacngtcgggctgatatgtgtacgtggtacagcgacggtaccccaaggaaccccaacccccaaactcctacactcctactacaacaataactccgacgcccggcctacgaggtaccgtcccctagaacccgtatttccctaccgttccgacccccgttaccgaaacgggttccccgggacctacccctacgtacccgtccccgttacccccgtacgggacccctaacgttccgaaccggggggtttccggccccggttcccgggggacccggtaagggtacggttacggggaacgggttccttaagggtatttaacgttaccggtggttacgccgtaaggggtacgttaggggactaacgtacgttaaccgggtgggttcgtccctttaagttcccgttcgtttaccgggaacgtaccgggaacctaacgggtcccttaacggttccgtttcgggtaacccg

SEQ ID NO: 330213 - DNA, 662 bp, Homo sapiens
  misc_feature: GZ8MTXP01B2648.2.76.G10.1.454.CMB.2.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcagccacctnagcgtctcgggtccccggnaggaggtcaccatctcttgtctggacgcacctcaacagtcggcgtgatatgtgtactgtaacagcacggtcccaggaacccaccccaaactcctnactctcacacaaatactcacgccgcctacgacggctacccngcccgtattctcgtcgccctacgaacgttcccggcctaacctccgacgtcccctacccgtggaccctagttccgacggggttcgggacccgttcccggggacgagggtacgtgggaacggtcctagtactttagttacgtcgttcggacgtaagggtcgtaggggtataacgggtaaacccgttaacgggttcggggttacttaccgtttaacgtttcccggtttcggtttacccgggaacccggttacggggtaacccgtaaaccggggtcccgttaccccggtttaaccggtttcggggtaaccccg

SEQ ID NO: 330214 - DNA, 796 bp, Homo sapiens
  misc_feature: GZ8MTXP01C897W.2.76.G10.1.454.CMB.2.raw
  modified_base (226)..(226): a, c, t, g, unknown or other
  misc_feature (226)..(226): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtccgtcggggtccccccggnaggaggtcaccatctcttgttctgggacggcaccctccaacgagtccggggcgtagattaagtcggtagttacgtgggtaaacaaggtaccgacgggttacccccgaagggtaaacccccgaaaccccccctaaaactcccctactactttcctaccttacaaacctaaataaatccgaaaccggccccggaccccttacgaacggggtaacccgttcccccgttacggtaaccccggttactttcccttcccgttccggacccctacccgtaaacggtccccggacctaccctaccgacgtcccctacccgttcggaccctagttccgagggttcgggccgtcccggggaccgtaagggcggttcggaacggtcttaggtaactttaacgttaccgttggaaccgtcgaaaggggtcggttacgggggattaacggaaaccgttaacccggggttgggggactttacgttaccgtttccgttcgggttacccggtaacccgggttaaccggggtaacccgtaacgggttaccccggttacccggttttccgttcgggggtaaacccccg

SEQ ID NO: 330215 - DNA, 644 bp, Homo sapiens
  misc_feature: GZ8MTXP01D6DRC.2.76.G10.1.454.CMB.2.raw
  modified_base (230)..(230): a, c, t, g, unknown or other
  misc_feature (230)..(230): n is a, c, g, or t
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcagggtcctgggccccagtctgtgctgactcacgcccaccctcagccgtcgtccggggtccccccggnaggacgggtccaccattcctcttgttctgggacgccaccctcaacagtcgggctgattaangtgtactggtaacagcacgggtaccccaagggaaccccgaaccccccaaatcctacacttcctctacaactaaagtaacncgaccgccgacctacgacgtacctcccgagccgtcttcctccgtcgtaccctacgacgtcccacctaccncgaccgtccctccgtcgactacgtcgcggtccggccgtccgggacgaggtacgtcgggacgtcgtagttaactttcgcgttggtacggcgtaagggtgtacggaactaacgaacgttacgggttgggttcgtacgtttacgttccgttcggttaccggaacgtacggtaaccgtacggtccgttccgttccgttaacgaaccg

SEQ ID NO: 330216 - DNA, 624 bp, Homo sapiens
  misc_feature: GZ8MTXP01AJ2S5.2.76.G10.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctggcccagtctgtgctgactcagcccacctnagccgtcgtcgggtcccccggnaggacggtccacctatcctcttgttctgggacgctaccctcaacgagtcgggctgattaatggtgtactggtaacaagcacggtaccccaaggaaccccgacccccaatcctacatctcacaacaatactcaccgccgcctagaggactccctgaaccgtatcctcgctccctacaacggtcccgactacctcacgtccctccgtaggacccagtcacgggtcggccgacccggggtacgagacgggtggtaacggtcctaagttaattaaccgttgcggtagaccgtagggtagtgggaatcggaaaccgttacgggttggttcgttacttaggttcccttcggttaccccggcgtacgggaacccgtaacggttccgttaccccggttcgttcggaacccg

SEQ ID NO: 330217 - DNA, 729 bp, Homo sapiens
  misc_feature: GZ8MTXP01CG529.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtcgtcgggtccccggnaggaggtcaccatctcttgttctggagcacctcaacagtcgggctgataatgtgtactggtaacaagcgacggtccccaaacgggaaccccgaaccccccaaactccctacaacttcctactacaacaaattaactcgaaccggcccgggccttacgacggggtacccttaccccgtacggaacccgtactttcccgtccgttaccgccccttaacccgaaacggttcccccgggaccctaaccccttacgacccggtcccccttaccccggtcgggacccctaacgttcccggaacggggttccgggggccccgttaccccggggggacccggtaagggtacggttcgggaacggggtcttaggtaaactttacgttacgtggtacgacgagggtagtcgggaatcggtaaccgttacgtggggttcttcgttagttccgttcggttaccggaaccgtacgggtaacccaagggttccccttaccggttcgttaacgggaacccg

SEQ ID NO: 330218 - DNA, 640 bp, Homo sapiens
  misc_feature: GZ8MTXP01DV36T.2.76.G10.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (392)..(392): a, c, t, g, unknown or other
  misc_feature (392)..(392): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgccaccctcagcgtcgtcgggtcccccggnagaggtcacatctntgtctggagcacctcaacagtcgggctgataatgtgtactggtacaagcgacggtccccaaggaaccccgaacccccaaatccctacacttcctactacaacaaataatccaacggcccggcctcgaggtaccgtcccctgaaccgtatttcccnctcgccctaccaacggtcccgaccacctccacgcccctccgtgaccctatcgaggtcgggccgtccgggacgaggaggtcggagggtcctaggttattaacgttcgtggtacgcgtagggtagtcggggaataacggaaccgttaacgggttggggttacgtcctttacgttccgttcggttacccgggtaaccggttacgggaacccttaacgggtccttaacccggtttcgtttccgggtaacccg

SEQ ID NO: 330219 - DNA, 716 bp, Homo sapiens
  misc_feature: GZ8MTXP01EDMCC.2.76.G10.1.454.CMB.2.raw
  modified_base (224)..(224): a, c, t, g, unknown or other
  misc_feature (224)..(224): n is a, c, g, or t
tcagacgctcgacacacgaccggtgctcgatttagtcactcatacaggggggagagatctgggggaagctcagcttcagctgtggtagagaagacaggattcaggacagtctccagcatggccggctcccctctcctcctcaccctcctcactcactgtgcagggtcctgggcccagtctgtgctgactcacgccaccctcacgcgtccgtcggggtccccggnagacggtcaccattctcttgtcgtggacgcaccctcaacgagtcgggctagattaatgtagtacgtcggtaacaacgaccgacggtaccccaaaggaaccccgaaaccccccaaacttccctacacttcctctacaactaaataactcgaaccggccggtcctagacggaaccgttccccgtagcccgtatttccctccgttcgaccccttaccgaaaccgggttccccggaccctacccgttaccgaccgtccccgttccccgttacgggtacccctaacgtttccgacgggttcgggccccggtacccgggggaccgagggtaagtcgggaacgggtctaggttaaatttacgttaccgtggttacgacggtaaagggtggttaaccgggattaacggaacttaaccggtgggtttctacggtttacttcgttccgttacggtccgtagggtaaccgtaacggtccgttacgttcgttaacggtaacccg

SEQ ID NO: 330220 - DNA, 634 bp, Homo sapiens
  misc_feature: GZ8MTXP01BJBH9.2.76.G10.1.454.CMB.2.raw
  modified_base (222)..(222): a, c, t, g, unknown or other
  misc_feature (222)..(222): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagacgctcgacacacgaccggtgctcgatttagtcactcatacaggggggagagatcgtgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggagggtcaccatctcttgttctggacggcacctccaacagtcgggcgtgataatgtgtactggtacagcacggtcccaggaacccgaccccaaactcctacactctctacaacaataactcgaacgccggacctgacggactccctacggaaccctnttctctcgccctacgaacgtcccgcctacctcncgtccctccnggaccatcgagggtcgggcctccggggacaagggctggaacggtctaacgttatttactacgtgtaggcgtaagggtacgtaggggtacttaacgacccgttaaacggttcggggttaacgtctttaacgttccgtttccggttaccggaaccgggttcgggaaaccctaaggggtcccgttaacccggttccgtttaacggaaccccgg

SEQ ID NO: 330221 - DNA, 777 bp, Homo sapiens
  misc_feature: GZ8MTXP01BBZFZ.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtctcgggtcccccggnagaggtcacatctcttgtctggagcacctcaacagtcgggcgtgataatgtgtactggtacaagcacggtccccaaggaaccccgaacccccaaactccctacacttcctactacaacaaataactccacgccggccctacgacgggtaccgtacccctacgtaacccgtactttccctactcgtacccccttaccgaaaccgttccccgggaccaacccgttccaacggtcccccttacccggtcgggacccctaagttcccgaaggggttcccggggacccgttaccccgggggacccggtaacggggtaaggttcgggaacggggttccttaaggtaaacgttttacgtttaaccggttcggttaggaaccgtaaagggggtaggtggggtaaacgttaaccgggtaaacccggttaaaccgggttgggggttcgttacccgtttaaacttcccggtttacgggtttacccgggaacccgggttaacgggggtaacccttaaaacgggggttccccttaaccccgggtttccggttttaaccggtaaccccgg

SEQ ID NO: 330222 - DNA, 702 bp, Homo sapiens
  misc_feature: GZ8MTXP01COJXS.2.76.G10.1.454.CMB.2.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcgagggtcctgggcccagtctgtgctgactcacgccaccctnagcgtcgtcgggtccccggnaggaggtcactatctcttgttctggacgccacctccaactagtcgggctgataagtgtagtactggtaacagcacggtcccaaggaacccacccccaaatcctcacttccnctacaacaatactacaccggccggaccctanacgggtacccgtccccgtagaacccgttactttcccgtcgtccgccccttacccgaaacggtccccgggaccctaacccgtcgtacccggcccttcccggtaggtcccctagtaccgacggggttcgggccccgttcccggggacggtagggtacgtcggggaagggttcctaagggttacttttaacgttaccggtaggttacggaccggtaagggtggtaggggactaacggtaacccgttaaggttcgggttacgttaccttagttcccgttccgtttacggaacccggtcgggaaccgtaacggtcccgttaccttccgtttgggaaccccg

SEQ ID NO: 330223 - DNA, 576 bp, Homo sapiens
  misc_feature: GZ8MTXP01AQ0HA.2.76.G10.1.454.CMB.2.raw
  modified_base (561)..(562): a, c, t, g, unknown or other
  misc_feature (561)..(562): n is a, c, g, or t
  modified_base (564)..(566): a, c, t, g, unknown or other
  misc_feature (564)..(566): n is a, c, g, or t
  modified_base (568)..(576): a, c, t, g, unknown or other
  misc_feature (568)..(576): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgccggccctcgacggggtccctgaccgtattctctgccctccaagtctggcacgtcagccttcctggacatccgtggccctccagtctgcggatggagtcttgtttatttctgttcagcgacgggatcgccaggccgaatggaactaagttggggtattcggggacgggacgggacctaaggttcgacccgttaccgtaagtcgacgacccgaaggtcctaccggccccccttgggtccctaccgttcctccgttcccctaccccttcccgtcgtcggtccgtacggtccgttcgtcggacggtccggggtcgtcgggaccgaacgggccgcgaagttggnngnnngnnnnnnnnn

SEQ ID NO: 330224 - DNA, 575 bp, Homo sapiens
  misc_feature: GZ8MTXP01CC4HB.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagagggtcaccatctcttgtctggagcacctcaacatcgggctgataatgtgtactggtacagcaggtccccaaggaaccgaaccccccaaatccctcattctctacaacaaataatcaacgccggcctgaggacgtcccctgaaccgatttcctctcgccctaccaagtcccggcacctcacgccctccgtggccatcgaggtcgggccgtccggggccgaggacgtggacggtctaggtattacttacgtgtgcaggtagtgggatcgaacttaccggtgggttcgtcttagttcgttccgttcggaaccgttggggaacctaacgggtccaaccggttccgtttgggtaaccc

SEQ ID NO: 330225 - DNA, 804 bp, Homo sapiens
  misc_feature: GZ8MTXP01DQ12C.2.76.G10.1.454.CMB.2.raw
  modified_base (226)..(226): a, c, t, g, unknown or other
  misc_feature (226)..(226): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagccgtcgtcggggtcccccgggnaggacggtcaccatcttcttgttcgtggacgccaccctcaacactcgggctgaataatgtagtacgtggtaacaagcgacggtaccccaaggaaaccccgaaccccccaaactccctactacttcctacctacaaacctaaataaactccgaacggccccggtacctacgaacgggtaccgttaccccctaggtaacccgtacttttccctccgttccgacccccttaaccgaaacggttccccggacctaacccttcaaccgtcccctcccgtcggacccctaagttccgacggggttccggggcccgttaccccggggggaccgtaaggggtacgttacggggacggggttacttacgggttaaactttaacggtttaaccgtgggttaaccgggaccggtaaagggggtattacggggggtaataacccgggttaaacgttaaacccggggtttggggttccggttaaccttttcgttacccggtttcccgttaaccccgggggtaaccgtaccgggggtaaccccgttaaacggggtccccgttaaccccgttccgggtttcggggaacccccg

SEQ ID NO: 330226 - DNA, 827 bp, Homo sapiens
  misc_feature: GZ8MTXP01DM7ZL.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtactgggcccagtctgtgctgactcagccacctcagcgtcgtcgggtcccccggnagagggtcaccatctcttgtctggagcacctcaacatcgggctgataatgtagtactggtacaagcacggtccccaagggaaaccccgaaccccccaaactcccctacaactttcctaccttacaaacctaaagttaaactccgaacggccccgggtaccctacgaacgggacgttcccccgttaggaaccccgtatttccctccttaccggaccccttacccgaaacgggttcccccgggaccctaaccccgttccgaaccggtcccccttacccccgttcggggaccccctaaagtttcccgaacggggttccgggggccccgttacccccggggggacccggaaacggggtaaggttacggggaacggggtacctttaggggtaaacttttaaaccgtttaaccggttgggttacgtaccggaaagggggtaacgttacgggggaattaaccgggaaacccgttaaacccggggtttgggggttccttaacccgttttaacgttccccggtttccggttacccggggtaacccggttaacggggtaaaccccgttaaacggggttcccgttaaccccgggtttccgtttaacggggtaaccccg

SEQ ID NO: 330227 - DNA, 733 bp, Homo sapiens
  misc_feature: GZ8MTXP01D8QT9.2.76.G10.1.454.CMB.2.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (413)..(413): a, c, t, g, unknown or other
  misc_feature (413)..(413): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnagaggtcacatctnttgtctggagcacctcaacagtcgggctagataatgtagtactaggtaacaagcgtacggtcccaacggaaccccgaaacccccaaactcctacactctacctacaacaaataactaccaacggcccggtacctacgacgggtaccgttaccccctaggtaacccgtacttttcccncctttaccggcccctaccgtaaacgtcccggaccctacctaccgccgccccttcccggtacggaccctaagtcgaacgggttcgggccgtcccggggacgacggtaggtgggaacggtcttaggtaactttacgttacgtgtaacggcgtaagggtagtacgggtataacggtaaaccgttccgggttaggggttcttaccggtttaacgtttcccgttacccgggtttacccggggtaaaccccgggtagggggttaaacccccgtaaaggggttccccgttaaacccccgggttcgtttttaaccgggggaacccccg

SEQ ID NO: 330228 - DNA, 660 bp, Homo sapiens
  misc_feature: GZ8MTXP01DKK28.2.76.G10.1.454.CMB.2.raw
  modified_base (222)..(222): a, c, t, g, unknown or other
  misc_feature (222)..(222): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagacgctcgacacacgaccggtgctcgatttagtcactcatacagggggggagagatctggggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtcgtcgggtccccggnaggaggtcaccatctcttgtctggacgcacctcaacgacgtcgggctggaataagtgtgtactggtacaagcgacggtcccgaacggaaacccgaaccccctaaactcctacgacttcctcctactaactaaataactccgaaccggcccggtaccctcgaacgggtacgttccccgtacgaacccgtactttccctcctcgaccccttaccgaaacggttccccggctaaccctccgaccgccccttacccgtggaccctagtcggacggtcgggcccgtccggggacgaggtggacggtaggtctagtaatttacgttcgngtacggnaggtagtcgggaattcgaacgttacgtggggactcctttagttcccttcggttccggtaaccgtaacgggaaccgtacggtccgttaccccggtttcgttcgggaacc

SEQ ID NO: 330229 - DNA, 743 bp, Homo sapiens
  misc_feature: GZ8MTXP01CPBQR.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnaggacggtcaccatctcttgttctgggacgccacctccaacgagtcgggcgtagattaagtgtagtacgtggtaacaagcgacggtacccaacggaaccccgaccccctaaactcctacacttctctacaacaaatatcaaccggccggtacctcgacggtaccgtcccctagaacccgtattccctccgtccgacccctaccgtaaccggtccccggaccctacccgtaccgacccgtccccgttccccgtcgggtacccctacgttaccggtaccgggttcccgggggccccgttaccccggggggaccgggtaaacgggggtacgttaacggggtacggggttacccgtttaggttaacttttaacgtttaccgtggttacggacgtaagggtaggtcggggtaataacgtaacgttaaccggttggggttacttacgtttacgttcccgtttcggttaccggaacggttaaccgggaaccgttaacggtcccttaccggttccgttcggtaacccg

SEQ ID NO: 330230 - DNA, 607 bp, Homo sapiens
  misc_feature: GZ8MTXP01AS5D5.2.76.G10.1.454.CMB.2.raw
  modified_base (224)..(224): a, c, t, g, unknown or other
  misc_feature (224)..(224): n is a, c, g, or t
  modified_base (261)..(261): a, c, t, g, unknown or other
  misc_feature (261)..(261): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (544)..(544): a, c, t, g, unknown or other
  misc_feature (544)..(544): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtcgtcgggtcccccggnagaggtccacatctcgttgtctggacgcacctcaacngtcgggctgataatgtagtactggtacaagccgacggtaccccaaggaaccccgaacccccaaactccctacacgtcctctacaacaaatactcgacgccggccngacggactccctagcccgtatcctctcncccgtacacgtcccgaccnctccacgccctcctggaccagtcgnggtcggccgtaccgggacgaggngtcgggagtctagtaactttagacgtggtcgngtaagggngttaggggatccggaaacttccgggtgggttacgtcgtttacnccgtttcgttacggcccgttaggggaaccttaacggtccgttaccggtcgtttcgggaacccg

SEQ ID NO: 330231 - DNA, 753 bp, Homo sapiens
  misc_feature: GZ8MTXP01AOJ15.2.76.G10.1.454.CMB.2.raw
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtccccggnagaggtcaccatctcttgtctggagcacctcaanagtcgggctgataatgtgtactggtaacagcacggtaccccaaggaaacccgaaccccccaaaatccctacaacttcctactcaaactaaataaactccgaaccggcccggtacccttacgaacggggtaccttaccccctacggtaacccgtactttccctacgtcccgaccctttaccccgaaacggttccccggacctaacccgttccgaacccggtccccttcccccggttcgggacccctaacgttccggtaacggggttccggggcccgttaccccggggggacccgggtaaagggcgttaggggaacggtccgttagggtaaactttacgttaccgttgggttaccgtcggaaagggtacggtgggtaacgtaacgtaaaccgttaaaccgggttggggttaactcgtttaacgttccgttccgtttacccgggaaccgttacgggaaacccgttaacggtccccgttaacccgttccgtttcggaaccccg

SEQ ID NO: 330232 - DNA, 659 bp, Homo sapiens
  misc_feature: GZ8MTXP01BWTKU.2.76.G10.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgccaccctnacggtcgtcgtccgggtccccggnaggacggtcaccattctcttgtcgtggacgcacctcaaactggtcggacgtnattaagtgtagtacgtaggtacagcgtacggtaccccaaggaaccccaccccaaactctcattcactcaaactaagtacncgaccgccggtcctagacggtaccgtccctacgaaccgtcttcctccgtcggtacccctacgaaccgggttcccaccctacccgtaccgcgtccccgtacccggtggaaccctacgtcgggtaccggtccgggggcccgtcccggggacggtaggtacggtcggtacgggtcttagggtatttaacgtcggtagtagcggtaaggtggtaaggtcaacgtcgttacggtggttgttacctattccgttcggttaccggccgttagggaaccctggtcccgttaccttcgggttgaacccg

SEQ ID NO: 330233 - DNA, 627 bp, Homo sapiens
  misc_feature: GZ8MTXP01AH7P0.2.76.G10.1.454.CMB.2.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (470)..(470): a, c, t, g, unknown or other
  misc_feature (470)..(470): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtccccggnagaggtcaccntctcttgtctggngcacctccaacagtcgggctgataatgtgtactggtacaagcacggtccccgaaggaaccccgaacccccaaactccctacacttctctacaacaatactcacgccggcctagacggacgtcccagaaccgtattcctcgtcgccctaccgaacgtcccgacctacctccacgcccctcccgtggacccatccgtagggtccgggcccgtcccggggacgtaggngtggacggtctagtatttagtacgtgcgtacgaggtacgtgggactaacggaaccgttaccgggtggttcgtacctttacgttcgttccgtttccgggaacccggttcggaacccgtaagggtccccttaccggtttccgtttaacggggaaccccg

SEQ ID NO: 330234 - DNA, 631 bp, Homo sapiens
  misc_feature: GZ8MTXP01EHNZI.2.76.G10.1.454.CMB.2.raw
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (322)..(322): a, c, t, g, unknown or other
  misc_feature (322)..(322): n is a, c, g, or t
  modified_base (387)..(387): a, c, t, g, unknown or other
  misc_feature (387)..(387): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagcgtcgtcgggtcccccggnagaggtcacntctcttgtctggagcacctccaangtcgggctgataatgtgtactggtaacagcacggtcccaaggaaccccaacccccaaatccctanactctctacaactaaagtaactccacggcccggtaccctagacggtaccttacccagaacccgtntttcctcctcgcccctacgaacgtcccgacaccctccaccgccctcccgtcggaccctagttccgacgggccgggtcccgcccggggacgaggtacgtagggacgtctaagtattaacgtcgttgagcgtaaggtgtggggattaagacccgttaacggtgggttcgtcttacttccggttcgttacccgggaacgttccgggaaacccgtagggtcccaacccggtttcgttaacgtaacccg

SEQ ID NO: 330235 - DNA, 672 bp, Homo sapiens
  misc_feature: GZ8MTXP01BU8N6.2.76.G10.1.454.CMB.2.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtcgtcgggtccccggnagaggtcacntctcttgtctggacgcacctcaacngtcgggctagataatgtagtacgtggtacagcgacggtacccaacggaaacccgaccccaaactcctacactctactacaacgtaaataactcaaccggccggtacctacgacgggtacccttaccccgacgtaacccgtactttcccgtaccgtccgtaccccttaccgaaacgggttccccgacctaacccgtccgaccggtccccttacccgtggacccctagtaccgcggggttcgggccccgaccgggggaccgaagggtacgtcggggaacggtctaggttaactttacgtacgtggtacgacgtaagggtgttcggggaataacggaaccgttacgggttggttactcttattccgttcgttaccgggaactcggggaactacgggtccttaccgttcgttcggaaccg

SEQ ID NO: 330236 - DNA, 615 bp, Homo sapiens
  misc_feature: GZ8MTXP01AICIG.2.76.G10.1.454.CMB.2.raw
  modified_base (224)..(224): a, c, t, g, unknown or other
  misc_feature (224)..(224): n is a, c, g, or t
  modified_base (386)..(386): a, c, t, g, unknown or other
  misc_feature (386)..(386): n is a, c, g, or t
  modified_base (464)..(464): a, c, t, g, unknown or other
  misc_feature (464)..(464): n is a, c, g, or t
  modified_base (500)..(500): a, c, t, g, unknown or other
  misc_feature (500)..(500): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctccaccctcctcactcactgtgcagggtcctgggcccagtctgtgctgactcacgcccaccctcagcgtcgtcgggtcccccggnaggacggtcacatctcttgtcgtggacgcaccctaccaacgagtcgggcgtagataagtgtgtactgtaacaagcgacggtacccaaggaaccccaccccaaactcctacatctctacactaatactcacgccgcctcgaggactccctagcccgtattccnctcgcctacgaacgtcccgcacctccgacgtccctccgtcgacctagtccgacggtcgggccgtccgggaccgtaggngtcggaggtctaggtattattacgtgtagcgtaggngtacggggataacggaacgttacggtggttactccgtttattccgttccgttacccgggtaaccgtccgggaacccgttaagggtccccgttaccggttccgttgggtaaccccg

SEQ ID NO: 330237 - DNA, 664 bp, Homo sapiens
  misc_feature: GZ8MTXP01AOFP0.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctccaccctcctcactcactgtgcagggtcctgggcccagtctgtgctgactcacgccaccctcagcgtcgtcgggtccccggnagacgggtcaccatctcttgtctggacgcaccctcaactagtcgggctagatagtgtgtactggtacaagccgacggtaccccaacggggaaccccaacccccaaactcctacacttcctactacaacaaagtactacgacgtcccggcctacgaacggaccttaccctacggcctacttccctctccgtcccttaccgaaccgtccccggacctaccctcgacgtcccctaccgtggacccctagtcgacgggtcgggcccgtaccggggacgtagacggtgggacggtctaggtactttatcgtggtgacgtaggggtagtacggggataaccggtaacgttaccgggttgggttctcgttacttcccgttccggttacgggaacccgtaggggtaacccgtaacggttccccttacccgggttccgtttcggaacccg

SEQ ID NO: 330238 - DNA, 690 bp, Homo sapiens
  misc_feature: GZ8MTXP01ASN0D.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccacctcagcgtcgtccgggtccccggnagacggtcaccatctcttgtcgtggacgcacctcaacagtcgggcgtagatatggtgtactggtaacaggcgacggtacccgaacggaacccaccccaaactcctacactctacctacaactaaataactcgaaccgccggacctacgacggtaccgtaccccgtagtaacccgtacttccgtacgtcccgtccccgttacccaaaccgggttccccgaccctacccgttcccgaccggccccctttacccgcggtacccctaggtaccgacgggttccgggggaccccgtccgggggaccgtagggaaccgttgggaacggtccttaaggtactttaacgtcgtaggtacggagtacgggtagtacgggactaacggtaaccgttaccggttgggacttccgttagttcccggttacgttcggtaaccgtggaacctaggtcccttaccgttcgttaacggaacccg

SEQ ID NO: 330239 - DNA, 729 bp, Homo sapiens
  misc_feature: GZ8MTXP01ELDJY.2.76.G10.1.454.CMB.2.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtctcgggtcccccggnaggacggtcaccntctcttgtctggagcacctcaacagtcggctgattaatgtcgtactggtaacagcacggtaccccaagggaaccccaccccctaaactcctacaacttcctactacaacaaattaaactccaacggcccggtacctacgacggggtacccttaccccaggtaacccgttactttcccgtaccgttccgaccccttacccgaaacggtcccggacctaccctccgaccgtcccctcccgtcggaccctagttccgagggtccgggcccgtaccggggaccggagggacggttagggacggtacttaggtaaacttttaacgtaccggttggttaggacccggtaggtaaagggttgggaattaacgggtaaacgttaacccgggttgggggttaacgttcctttaacggttcccgtttcgggtttaacccggggaaccggttacgggtaaaacccgtacggggtacccaacccgtttcgttaaagggtttcccgg

SEQ ID NO: 330240 - DNA, 730 bp, Homo sapiens
  misc_feature: GZ8MTXP01CXOED.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggagggtcaccatctcttgttctggagcacctcaacatcgggcgtagataatgtgtactggtaacaagcacggtaccccaacgggaaaccccgaaccccccctaaaactcccctacaactttcctacctacaaacctaaataactaccgaaccggcccggacccaacgacggtaccgtcccccgtagaacccgtattccctcgtcgtccctaccgtaacggtcccgcctacccgtcaccgtccctcccgtacggacctacgttccgacggggtcgggcccgtaccccggggacccggagggtagtacgggacgggtaccttaggttaatttaacgttaccgtggtacgcgtaagggtagttagggggaactaacggtaaaccgttaaccgggtttggggttcgttaacctttagttacccgtttccgggtttaacccggggaacccggttacggggaacccgttaacgggtacccttaccccgggtttccgttaacgggtaaccccgg

SEQ ID NO: 330241 - DNA, 703 bp, Homo sapiens
  misc_feature: GZ8MTXP01E030Q.2.76.G10.1.454.CMB.2.raw
  modified_base (234)..(234): a, c, t, g, unknown or other
  misc_feature (234)..(234): n is a, c, g, or t
  modified_base (628)..(628): a, c, t, g, unknown or other
  misc_feature (628)..(628): n is a, c, g, or t
tcagacgctcgacacacgaccggtgctcgatttagtcactcatacaggggggggagagatctggggggaagctcagcttcagctgtggtagagaagacaggattcaggacagtctccagcatggccggcttccctctcctcctccaccctcctcactcactgtgcagggtcctgggcccagtctgtgctgactcacgcccaccctcacggcgtcgtccggggtccccccggggnaggacggggtccacctatcgttctttgttcgtgggacggccacctccaacagtcgggcgtgataatgtagtactggtacaagcgacggtaccccaagggaaccccacccccaaactcccacactctctacaacaaatatccacgcccggcctacgaggaccgtcccctgaacccgtattcctctcgccctaccgaacggtccccggaccaacccgtccgaccgtcccctaccccggtcggacccctagtccggacggggtccgggggccccgttccccggggggaccggaggacgggtcgggaacggtccttaggtaacttttacgttacgttggcggacgagggtagtagggtacgtaacgaaccgttaaccggtggggttccgtacgtttcnccgtttcggttacccgggtaacccggttacgggaacccgtaacgggttcccaccccgttcggttcggtaaccccg

SEQ ID NO: 330242 - DNA, 658 bp, Homo sapiens
  misc_feature: GZ8MTXP01D135S.2.76.G10.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtcgtcgggtccccggnagaggtcacatctnttgtctggagcacctcaacagtcggcgtagattaatgtgtacgtggtacaagcgacggtccccaaggaacccgaaccccctaaactcctacacttcctctacaataactaacgtccacgcccggcctacgaaggtacccgtcccctagaacccgtacttcccgtctcgacccccttacggaacgttccccggacctacccttcgaccggtccccttcccgtacggaccctagtccgacggggttcgggcccgtcccgggggacgaagggtagtcgggagggtcctttaggtacttttacgtacgtggtacggcgtaagggtaggttagggtactaacggaaccgttaccgttggggttacgtcttaacgttccgttcgttacggccgtgggaacctacgtccgttaccgttcttcggaacccg

SEQ ID NO: 330243 - DNA, 756 bp, Homo sapiens
  misc_feature: GZ8MTXP01AL0WK.2.76.G10.1.454.CMB.2.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctnagcgtcgtcgggtccccggnagaggtcacntctcttgtctggacgcacctcaacngtcgggctgatatgtgtactggtacaagcgacgggtccccaagggaaccccaacccccaaactccctacaacttcctctacaactaaataaactcgaaccggcccgggacccttacgaacgggtacccgttcccccgtaacggtaacccgtactttcccgtaccttccggtacccccgttaacccggtaaaccggttcccccgggaccctaaccccgttcccgacccgggtccccccttaccccggttcggggacccctaacgttcccggtacgggggttcccgggggaccccgttccccggggggacccgggttaagggacggttacggggaacgggttccttagggttaaattttacgttaccgtggtaccgacggtagggtagtggggactaacggtaacccgttaccgggttgggttaccgtacttacgttccgttcggttaccggaacgtcggggaacctaagggtccccttacggttccgttcgggaacccg

SEQ ID NO: 330244 - DNA, 871 bp, Homo sapiens
  misc_feature: GZ8MTXP01D2LNX.2.76.G10.1.454.CMB.2.raw
  modified_base (227)..(227): a, c, t, g, unknown or other
  misc_feature (227)..(227): n is a, c, g, or t
tcagacgctcgacacacgaccggtgctcgatttagtcactcatacaggggggagagatctgggggaagctcagcttcagctgtggtagagaagacaggattcaggacagtctccagcatggccgcttccctctcctcctcaccctcctcactcactgtgcagggtcctgggcccagtctgtgctgactcacgcccaccctcagtccgtcgtccggggtccccccggngaggacggtccacctattccttctttgttcgtgggacgccaccctaccaacgtacgtcgggcgtagtataagtgtgtacgtggtaacagcgacggtacccgaacggaaccccaaccccctaactcctacacttcctactacaactaaataactccgaaccggtcccggtacctacgaacggtacccgtacccccgtacgtaacccgtactttcctccgtacccgtaccccgtaccgtaaaccgggtcccccggaccctaaacccgttccgtaaccccggtccccctttaccccggacgggtaacccccttaagtttccccgggaaagggggttccccggggcccccgggttacccggggggaacccgtaaagggggttacgggttacgggggacggtttccgtttaaacgggtttaaacttttaaccgtttccggttaaggggttaccgaacgggtaagggttaaccggttaggggtaacgtaacccggtaaacccgtttacgggggtacggggtttcttacccggtttttaacgttccccggtttaccgggtttaacccgggaacccgggtttaccggggaaacccgtttaccggggttccccgttaacccgggttttcccgggtttaacgggtaaacccccg

SEQ ID NO: 330245 - DNA, 787 bp, Homo sapiens
  misc_feature: GZ8MTXP01CZ82Q.2.76.G10.1.454.CMB.2.raw
  modified_base (225)..(225): a, c, t, g, unknown or other
  misc_feature (225)..(225): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcacgggtcctgggcccagtctgtgctgactcacgccacctcagcgtcgtcgggtcccccggagnggtcaccatcttcttgtctggacgccacctcaaactcggtcgggcgtagtataacgtgtcgttaacgaggtaacaacggcaacgggtaccccaacgggaaaccccgaacccccctaaatccctacactttcctaccttaccaaactaaactaacgtccgaccggtaccccgggtcctagaaccgggtccgttaaccccgttcgaacccgtctttccctcgtacgtcccctacggtaacgtccccggactaacccgtcaaccgtccccgtaccgtcgaccctaacgtccgtacggggtccgggacccgttacccggggacggtaacgggtacggtacggggaacggtccggttaattaaacgtttaacgtttcggtaggttaccgaacgggtacggttaacgggtgggtaaacgttaaccggaaaccgtttaaacgggggttacggttcgtttacccggtttaacttccggttaaccggtttaccggggtaacccgtttacgggggaacccgttaaacggggttccccgttaacccggtttcccggtttcggtaaaccccggg

SEQ ID NO: 330246 - DNA, 686 bp, Homo sapiens
  misc_feature: GZ8MTXP01CRYEZ.2.76.G10.1.454.CMB.2.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcacgcccaccctcagcgtcgtcgggtcccccggnagagggtccacctatctcttgttctgggacgcacctcaacatcgggctgataagtgtgtactggtacaagcaggtccccaaggaacccaacccccaaactcctactacttccncttacaactaaataactcaacggcccggacctgaacggtactccccgtagaacccgtattccgtctcggcccctaccaaacggtcccgacctaccgtccaaccgtcccttccccgtcggacctactacgacggtcgggacctcccgggggaccgaagggtacggtcggaacggggttcaacgggttactttaacgtaccgttggttaccggacgtaacggggtagtaccgggggtaataacggtaaacccggttaccgggtttgggccgttacgtttcgttacccgtttcgttacccgggtaacgttacggaaccgttaacgtcgttaacccgttccgttaaggtaacccg

SEQ ID NO: 330247 - DNA, 683 bp, Homo sapiens
  misc_feature: GZ8MTXP01BNUTF.2.76.G10.1.454.CMB.2.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctnacgcgtcgtcggggtcccccggnaggacggtcacntctcttgtctggacgcaccctcaacacgtcgggcgtagattaatgtagttacgtggtaacaagcgacggtaccccgaacgggaacccaccccctaaactcctactactctctacaactaaatactcgacggccgtacctgacggccgtaccccgtgaaccgtattcctactcgcccttacgacgtcccgacctccctacgaccgtccccgttcccgtacggtaccctacgtccggtaacgggtcccgggggtccgtccccgggggaccggtagggtacggtcggggtaacgggttccttaagggttaaactttacggttaaccgttggtacgacggtagggtagtagggtcgtaacgtaacgttaacgggttgggttcttacgttacgttccgttcgttaccggccgttaggaaccgtacggtcgttaccgttcgttcgaacccg

SEQ ID NO: 330248 - DNA, 733 bp, Homo sapiens
  misc_feature: GZ8MTXP01D3BBH.2.76.G10.1.454.CMB.2.raw
  modified_base (225)..(225): a, c, t, g, unknown or other
  misc_feature (225)..(225): n is a, c, g, or t
  modified_base (505)..(505): a, c, t, g, unknown or other
  misc_feature (505)..(505): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgcccaccctcagccgtcgtcgggtcccccggnaggaggtcaccatcttcttgttctggagccacctaccgaacagtcgggcgtagattaagtgtagtacgtggtaacaaggctacggtaccccaaggaaccccgaacccccctaaagtccctacacttcctctacaaacctaaataactccgaacggccccggtacctacgaaccgggtaccgtaccccctaggtaacccgtactttccctcccgttacgacccccgttacgtaaaccgggttccccgaccctaacccgtccgacccgtccctttaccccgnggtacccctaacttcggacgggttccggggcccgtcccgggggacgaacgggtaacggtgggacgggttaccttagggtaattttaaacgttcgtcgtaggaacggtgggtaaagtccggggtaatcggtaaaccttacgggttgggttctacgtttacgttccgtttcggttacccggtcggtacgggaaccgtaacggtcccgttaccgttaaccgttgaaccccg

SEQ ID NO: 330249 - DNA, 536 bp, Homo sapiens
  misc_feature: GZ8MTXP01CNS59.2.76.G10.1.454.CMB.2.raw
  modified_base (279)..(279): a, c, t, g, unknown or other
  misc_feature (279)..(279): n is a, c, g, or t
  modified_base (518)..(519): a, c, t, g, unknown or other
  misc_feature (518)..(519): n is a, c, g, or t
  modified_base (521)..(523): a, c, t, g, unknown or other
  misc_feature (521)..(523): n is a, c, g, or t
  modified_base (525)..(532): a, c, t, g, unknown or other
  misc_feature (525)..(532): n is a, c, g, or t
  modified_base (534)..(536): a, c, t, g, unknown or other
  misc_feature (534)..(536): n is a, c, g, or t
tcagacgctcgacacacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaacgccccaaactcctcatctataccaatgatgtgcggccctgaggggtccctgaccgtattctctgcctcaagtctggcacgtcacgccttccnggacatccgtgcctccagtctgcggatgaggtctgttttatttctgttcaggtcagggtatcgccagccggaatcggactaagttgggtatcggggcgggacgggacctaaaggttcgacccgtcctaagtcacgcccgaaaggcctcgtaccccctcggtactacgtcctcgttccccacccttcctcgtcgtcgacgcgtcctaggcgcggggctcggacgacggcgaacgattagnngnnngnnnnnnnntnnn

SEQ ID NO: 330250 - DNA, 693 bp, Homo sapiens
  misc_feature: GZ8MTXP01D3SHW.2.76.G10.1.454.CMB.2.raw
  modified_base (221)..(221): a, c, t, g, unknown or other
  misc_feature (221)..(221): n is a, c, g, or t
  modified_base (439)..(439): a, c, t, g, unknown or other
  misc_feature (439)..(439): n is a, c, g, or t
  modified_base (545)..(545): a, c, t, g, unknown or other
  misc_feature (545)..(545): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcaggtcctgggcccagtctgtgctgactcacgccacctcagccgtcgtccgggtccccggnaggacggtcaccattcttcgttgttcgtgggacgacctaccctcaaacgtacgtcgggcgtagaattaagttcggtagttacgtaggtaacaagcgacggtaccccgaaggaaaccccgaaccccctaaactcccctacacttcctacttaccaaactaaataaactccgaacccggtccggtaccctagaccggtaccgtcccccgtagaacccgtntttcccgtcgtcgaccccgtacccgaaacggttccccgacctaccgtccgtacgtccccgtccctcgggaccctacgtcgtagggtcgggaccgtccggggaccgnggaacggtggaacgtcttacggtatttacgttgtgtcgacgtaggtagtaggtactaagaaccgttacggtggttactacgtttacttcgttcgttaccggtaaccgtagggaactaaccggtccgttacgttccgtttcggaacccg

SEQ ID NO: 330251 - DNA, 668 bp, Homo sapiens
  misc_feature: GZ8MTXP01B8IPY.2.76.G10.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (455)..(455): a, c, t, g, unknown or other
  misc_feature (455)..(455): n is a, c, g, or t
  modified_base (534)..(534): a, c, t, g, unknown or other
  misc_feature (534)..(534): n is a, c, g, or t
tcagacgctcgacacacgaccggtgctcgatttagtcactcatacaggggggagagatcgtgggggaagctcagcttcagctgtggtagagaagacaggattcaggacagtctccagcatggccggcttccctctcctcctccaccctcctcactcactgtgcagggtcctgggcccagtctgtgctgactcagcccacctnagccgtcgtcggggtcccccggnacggagggtccaccgtatctcgttgtcgtgggacggccaccctaccaaacgacgtcgggctagattaatgtagtacgtaggtaacaagccgacggtaccccgaacggtaaacccgaaccccccctaaagtccccttacgaactttcccgtactacaaacctaaataaacgtcaacccgccggtacctacgaaggtacccgtcccgtacgaacccgtacttctcggttccncccttaacccgaacgtccccgtacaccgtccaccggcccctccgtcgaccagtacgaggtcggccgttacgggcgaagngtggagtctagtattagtacgtgagcgtaagggtagttcggggattaagaacccggaaacgttggggttctacgttaacttcgttccgttaccggtaacggtaggaacctacgggccttaccgtccgttgtccg

SEQ ID NO: 330252 - DNA, 602 bp, Homo sapiens
  misc_feature: GZ8MTXP01DO9MX.2.76.G10.1.454.CMB.2.raw
  modified_base (222)..(222): a, c, t, g, unknown or other
  misc_feature (222)..(222): n is a, c, g, or t
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagccgtcgtcggggtcccccggnaggacgggtccacctattcttcttgttcgtgggaacgccacctcaacagtcgggctgataatgtgtactggtacagcacggtccagacccaccccaatcctnactcactacactaatatcgacgccggcctgaggcgtccctgaaccgtntcgtctcgccctacaggtcccgcctaccncacgtcccctccgtggaccagttcgagggccgggtccgccccggggagtaggtacgggacggtaacggtcttaggtatttaaccgtgttggtacgagtagggtaacgtggggtaataacgtaacgacggttggttactctttaagccgttcgttacgggaacctacgggaactacgggtcccttacggttcgttcggaacc

SEQ ID NO: 330253 - DNA, 640 bp, Homo sapiens
  misc_feature: GZ8MTXP01EWY6W.2.76.G10.1.454.CMB.2.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctnagcgtcgtcgggtccccggnaggaggtcacatctcttgtcgtggacgccacctccaanagtcgggctgaataagtgtatacgtggtaacagcacggtacccaggaacccaccccaactcctcactctctacaactaataacgtcacggccgtacctagacggtacccttcccacggtaaccctgttcctccgtacgaccccttacgacgggttccccgactacccgtcgaccgtcctcccgtagaccctagtcgtacgggtcggaccgtccgggacgaggacgtcggacgtccttagttaactttaagtcctaggtcgacggtaggtacgtagggagtaacgaacggttaccggttgggttacctacgtttacgttccgttcggttaccggtaacggtaccggaaccgtaacggtccgttacgttccggttcgaacccg

SEQ ID NO: 330254 - DNA, 797 bp, Homo sapiens
  misc_feature: GZ8MTXP01BGXO9.2.76.G10.1.454.CMB.2.raw
  modified_base (229)..(229): a, c, t, g, unknown or other
  misc_feature (229)..(229): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcacgccgtcgtccggggtccccccggnaggacgggtccacctattccttcgtttcgttcgtgggacggcctaccctaccgaaacgtacgtcggggcgtagtaacttaagtcggttagtaccgttaggtaaccaaggccgtaaccgggtacccccgaaagggtaaaccccccgaaccccctaaacttccctactacttcctactaccaaactaaattaactccgaaccggtccccggtacctacggaacggtacccgttaccccgtagaacccgttactttcccgttacgtaccgtaccccgttaaccgaaccggttccccggaccctacccgttaccgacccgtccccgttacccgtcgggtaacccctaggtaccgtacggggtccgggtaccccgggtacccggggaccgggtaagggacggttcgggaacgggttcctagggttactttaacgttcgtggtacgtcgtagggttagtacgggtacgtaacgaaccgttacggtgggttactaccgttattccccgttcggttacccggaaccgttagggaacccgttacgggtccttacccggttccgttaacggaaccccg

SEQ ID NO: 330255 - DNA, 634 bp, Homo sapiens
  misc_feature: GZ8MTXP01EPWB6.2.76.G10.1.454.CMB.2.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccggnaggacggtcaccatctcttgttctggngccacctcaacatcgggctgataatgtgtactggtacaagcgacggtccccaaggaacccacccccaaatccctanactctcacacaataactcacgccgtcctnacggctacccngaacccgattctctcgtcccctaccgaacggtcccgaccaccctcaaccgtcccctccgtggacccaagttccgagggttccgggcccgtaccggggaccgagggagtcggacggtctagtatttagtactggttcgcgtaggagtgggataaggaaccttaaccggttggggttactaccgtttattacccgtttccggttaccgggtaacccgttcgggaacccgttaacgggtcccttacccggttccgttaacggggtaacccc

SEQ ID NO: 330256 - DNA, 788 bp, Homo sapiens
  misc_feature: GZ8MTXP01A1IYH.2.76.G10.1.454.CMB.2.raw
  modified_base (221)..(221): a, c, t, g, unknown or other
  misc_feature (221)..(221): n is a, c, g, or t
  modified_base (532)..(532): a, c, t, g, unknown or other
  misc_feature (532)..(532): n is a, c, g, or t
tcagacgctcgacacacgaccggtgctcgatttagtcactcatacaggggggagagatctgggggaagctcagcttcagctgtggtagagaagacaggattcaggacagtctccagcatggccgcttcctctcctcctcaccctctcactcactgtgcagggtcctgggcccagtctgtgctgactcgacgccacctgagccgttcgtcgggtcccccggnaggtacgggtcacgtattctcttagtcgtggacgccacccgtaccaacgacgtccgggacgttagtaagttagtcggtacggttaccgtacggtaaccgaaggtaccgacggttaccccgaaggggaaccccctaacccccgtaaattccccgtactaccgtttacgtaccgtacaaactaaacttacgtccgaaaccggtcccgtacctcggtaaacggtcccgttaaccctacggtaacccgttacttcccgtacgtccgtacccgtacgtaaccggtccgaccctacgtacgaaccgtcccgttacgnggtaccctagtcgtaacgggttccggaccgttaccgggggactaaagggtcttacggggacggttaccgtacgttaacgttacgttaacggtcggttaccggagttaaccgggtacggttaaggccggttaaaccggaccgttaaaccgggttgggttcttaaccgttaacgttcggttaccggttaccgggtaacccggtcgggttaaacccgacgtttccgggttaccccggtttaagttcccgggtaaacccg

SEQ ID NO: 330257 - DNA, 696 bp, Homo sapiens
  misc_feature: GZ8MTXP01BL37I.2.76.G10.1.454.CMB.2.raw
  modified_base (228)..(228): a, c, t, g, unknown or other
  misc_feature (228)..(228): n is a, c, g, or t
  modified_base (330)..(330): a, c, t, g, unknown or other
  misc_feature (330)..(330): n is a, c, g, or t
  modified_base (395)..(395): a, c, t, g, unknown or other
  misc_feature (395)..(395): n is a, c, g, or t
  modified_base (567)..(567): a, c, t, g, unknown or other
  misc_feature (567)..(567): n is a, c, g, or t
tcagacgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggccccagtctgtgctgactcagcccaccctcagccgtcgtcggggtccccccgggnaggacgggtcactatctcttgtctggagcacctcaacagtcgggctgataagtgtagtactggtacagcgaggtacccaaggaacccgacccccaaactccncacttctctacaacaataaagtcaaccgccggtacctcgacgggtaccgtcccctaggaaccctntttcccgtccttcgtacccctaccggtaaacgttcccggacctaacccgtccgtaccggtccctccccgtgggacccctaggttcgacgggtcggggccggttaccccggggaccgaggagttaggacggtccgttagtactttaaccgttagtgtacgtaggagggttagngggtaaacttcggaaaccgttaccgggtggggttacttaccgtttaacttccgttccggttacccgggtaaccgtccggggtaacctaaacggggtcccttaccccgggtttccgtttcggaaccccgg

SEQ ID NO: 330258 - DNA, 485 bp, Homo sapiens
  misc_feature: GZ8MTXP02IQYWB.2.76.G10.1.454.CMB.2.raw
  modified_base (480)..(485): a, c, t, g, unknown or other
  misc_feature (480)..(485): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtcccctgaccgattctctgcctccaagtctggcacgtcagccttcctggacatccgtggccctccagtctgcggatgaggctgtttatttctgttcagcacgggatgccagccggaatggcaattggggtattcgggcggaggaccaagttgaccgtcctaagtcagcccaaggctgccccctggtcactctcgttccccgcccttcctctcgtcgagggtcctgagcgggctggcaaggcgcatagnnnnnn

SEQ ID NO: 330259 - DNA, 678 bp, Homo sapiens
  misc_feature: GZ8MTXP02HAM9M.2.76.G10.1.454.CMB.2.raw
  modified_base (219)..(219): a, c, t, g, unknown or other
  misc_feature (219)..(219): n is a, c, g, or t
  modified_base (343)..(343): a, c, t, g, unknown or other
  misc_feature (343)..(343): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgtctggagcacctcaacatcgggctgataatgtgtactggtacaagcaggtcccaggaaccgacccccaaatcctcatcctctcaacaataatcacgccggccctnacggatccccctgacccgtatttctctcgcccttacgaaacgtcccggcctaccctcacgccctccctggccctactcgacggttcgggcccgttcccggggacccgagggagttcgggacggtccgttgggtaactttacgtttaaccgtggttacggaccgtaagggggtacgttagggggaattacgggaaaccgttaaacccgggttgggggttccgttacctttttaacgtcccggtttccggtttaccggggtaaccccgtttacgggggaaaccccgtaaacggggttccccgtaaccccgggtttcccgttttaacgggtaccccgg

SEQ ID NO: 330260 - DNA, 503 bp, Homo sapiens
  misc_feature: GZ8MTXP02G5YVF.2.76.G10.1.454.CMB.2.raw
  modified_base (493)..(503): a, c, t, g, unknown or other
  misc_feature (493)..(503): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcgaggggtccctgaccgattctctgcctccaagtctggcacgtcagccttctggacatccgtgcctcagtctgcgatgagcttgtttatttctgttcagcacgggatcgccagccggaatggacaagtttggggtattcggggcggtagggaccaaggttcgacccgtctaagtcacgcccaaggcctcgccccctggtccactcctcgttccccgccctcctcgtgtccgagcgtcgtgacggcgggctggcaggcgacagtagnnnnnnnnnnn

SEQ ID NO: 330261 - DNA, 598 bp, Homo sapiens
  misc_feature: GZ8MTXP02HS22X.2.76.G10.1.454.CMB.2.raw
  modified_base (362)..(362): a, c, t, g, unknown or other
  misc_feature (362)..(362): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(598): a, c, t, g, unknown or other
  misc_feature (588)..(598): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccgcccccaaactcctcatctataccaatgatgtgccggccctcgacggggtccctgaccgtattcctctcgccctccaagtctggccacgtcagtcccttccgtggacagtcccggtggcccctccagtctggcggatggaggtcttgttttatttcgtgttcagtcgaacgggtntcgcccgaggccggaatggactaagtttggggttattcggggcggacgggacctaaggttcgaacccgtctaaagtccacgacccgaaggtcctcgccccccgtcggtccaccgttccctccgtttcccccaccccctttccttccgttcgtccgacggtcccgttcgtggcgggcccggggtcgtcggggaccgaacggggccgaccgtaaggtggngncncncnnnnnnnnnnn

SEQ ID NO: 330262 - DNA, 487 bp, Homo sapiens
  misc_feature: GZ8MTXP02JH0J7.2.76.G10.1.454.CMB.2.raw
  modified_base (482)..(487): a, c, t, g, unknown or other
  misc_feature (482)..(487): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatcgccagccggaatggacaagttggggtattcgggcgggagggaccaaggtttcgaccgtcctaagtcagcccaaggctcgccccctggtcactctcgttccccaccctcctctgtcgagcgtctgagcgggctggcaggcgcatgnnnnnn

SEQ ID NO: 330263 - DNA, 633 bp, Homo sapiens
  misc_feature: GZ8MTXP02IKLN4.2.76.G10.1.454.CMB.2.raw
  modified_base (221)..(221): a, c, t, g, unknown or other
  misc_feature (221)..(221): n is a, c, g, or t
  modified_base (341)..(341): a, c, t, g, unknown or other
  misc_feature (341)..(341): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtcccccgggnaggagggtcaccatctcttgttctggaggcacctccaacatcgggcgtgataatgtgtactggtacaagcaggtccccaggaacccgacccccaaactcctcatcctctcaacaattaancacgccgccctcgaggtactccctagacccgtattctacctcgccccttaccaaacggttcccggcctaaccctccgacgccccctccccgtggccctaactccgaggttcggggcccgttcccggggaccggaggacgtggaacggcttaggaatttacgttaccgtggtacgcgtaggtagtggggaactacggaaccgtaaaccggtggggtacgtactttacgtccgttccgttaccggaaccgttgggaaccctaacgggtccaccccggtttcgttcggtaacccg

SEQ ID NO: 330264 - DNA, 512 bp, Homo sapiens
  misc_feature: GZ8MTXP02GMXH9.2.76.G10.1.454.CMB.2.raw
  modified_base (217)..(217): a, c, t, g, unknown or other
  misc_feature (217)..(217): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagagggtcaccatctcttgttctggaggcacctccaacatcgggctgataatgtgtactggtacaagcaggtcccaggaaccgacccccaaatcctcatctctcacaataatcagcgcctcaggatccctgccgattctctgccctcaagtcccgcacctcacgccctccctgccatcagtggctccgggcgagatgagctgattattactgtgcaggatgggatgacacgtgggtagcttatcttcgttcggaaccgttcgggaacctaaggtccaccgttccgttcggtaccg

SEQ ID NO: 330265 - DNA, 496 bp, Homo sapiens
  misc_feature: GZ8MTXP02GNH0S.2.76.G10.1.454.CMB.2.raw
  modified_base (335)..(335): a, c, t, g, unknown or other
  misc_feature (335)..(335): n is a, c, g, or t
  modified_base (485)..(496): a, c, t, g, unknown or other
  misc_feature (485)..(496): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttattctgttcagcacgggntcgccagccggaatggcaagttggggtattcgggcggagggaccaagtttgaccgtctaagtcagcccaaggctcgccccctcggtcactctcgttccccaccctcctctgtccgagccgtctgacgcgggctggccaaggcgcagtagnnnnnnnnnnnn

SEQ ID NO: 330266 - DNA, 604 bp, Homo sapiens
  misc_feature: GZ8MTXP02GWFZU.2.76.G10.1.454.CMB.2.raw
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgttctggagcacctcaacatcgggctgataatgtgtactggtacaagcaggtcccaggaaccgacccccaaatccncatctctcaacaatactcacgccgcctgaggactccctgaccgtattcctctcgccctacaacgtcccgcacctcacgccctccgngcccatcgacggtcgggcccgtccgggggacccgaaggacgtcgggaacgggtccttaggtaacttttacgttacgtggtacgacgaggtagtgggggactacgggaaacaaccggttggggtctactttactcctttcgttaccgggaaccgttacggggaaccctaacggggtccctaacccggtttccgttacgggtacccc

SEQ ID NO: 330267 - DNA, 572 bp, Homo sapiens
  misc_feature: GZ8MTXP02H71AD.2.76.G10.1.454.CMB.2.raw
  modified_base (218)..(218): a, c, t, g, unknown or other
  misc_feature (218)..(218): n is a, c, g, or t
  modified_base (481)..(481): a, c, t, g, unknown or other
  misc_feature (481)..(481): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctcgggtcccccggnagagggtcaccatctcttgttctggagcacctccaacatcgggctgataatgtgtactggtacaagcaggtcccaggaaccacccccaaatcctcatctctcaacaataatcacgccggccctgaggactcccctgacccgtatttctccgtgccccttaccgaaagtccccggactaccctcacgcccctcccgtgcccattcgaggtcgggccgtccggggaccgaggatcggaggctggatttaagtctggtgacgaggngtgggatacgactacgtggggtacnctttacnccgttcgttacggaaccgttcggggaacctaacgggttccacccgttcgttcggtaccg

SEQ ID NO: 330268 - DNA, 513 bp, Homo sapiens
  misc_feature: GZ8MTXP02JWTTG.2.76.G10.1.454.CMB.2.raw
  modified_base (500)..(513): a, c, t, g, unknown or other
  misc_feature (500)..(513): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccgccccaaactcctcatctataccaatgatgtgccggccctgacggggtccctgaccgattctctgcctccaagtctggcacgtcagccttcctggacatccgtggcctccagtctgcggatgaggcttgtttatttctgttcagcacgggatcgccagccggaatggactaagttggggtattcgggcgggaggaccaagttcgaccgtcctagtcagcccgaaggctcgccccctggtcacgtcttcgttccccaccctcctctgtcgagtccgtcgtcggacgtcggggctgggaccgaacggcgcagtgnnnnnnnnnnnnnn

SEQ ID NO: 330269 - DNA, 555 bp, Homo sapiens
  misc_feature: GZ8MTXP02GWBWD.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgttctggaggcacctccaacatcgggcgtgataatgtgtactggtacaagcaggtcccaggaaccgacccccaaatcctcatctctcacaataatcacgcgccctcaggactccctgaccgtattctctcgccctccaagtcccggcaccctcacgccctccctgcccatccaggtcgggcctccggggccgaggatcggaggctgattattacgtgtgacgaggagtggggatcgactaccgtggggtctcttacgtcctcgttacggaaccgttcggggaaccgtaacggtccacccggttccgttacggtacccg

SEQ ID NO: 330270 - DNA, 484 bp, Homo sapiens
  misc_feature: GZ8MTXP02GEZAO.2.76.G10.1.454.CMB.2.raw
  modified_base (337)..(337): a, c, t, g, unknown or other
  misc_feature (337)..(337): n is a, c, g, or t
  modified_base (478)..(484): a, c, t, g, unknown or other
  misc_feature (478)..(484): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggccccaaactcctcatctataccaatgatgtgcggccctcaggggtccctgaccgattctctgcctccaagtctggcacgtcagccttcctggacatccgtggcctccagtctgcggatgaggtctgtttatttctgttcagcacgggntcgccagccggaatggcaagttggggtatcgggcggagggaccaagttgaccgtctaagtcagcccaaggctcgccccctggtcactctcgttccccaccctcctctgtcgagcgtctgagcgggctggcaaggcgcatgnnnnnnn

SEQ ID NO: 330271 - DNA, 586 bp, Homo sapiens
  misc_feature: GZ8MTXP02HXM5N.2.76.G10.1.454.CMB.2.raw
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccggcagagggtcaccatctcttgttctggagcacctccaacatcgggctgataatgtgtactggtacagcaggtcccaggaaccgacccccaaatcctacatctctcaacaataatcacgccgccctcaggactcccctgacccgtattcctctcgccctccgaaagtcccggcaccctcacgccctccctgccactcacggtcgggcctccggggaccaggatggaggctaggactttagttactgtgcgaggaagtggggattcggaacctaaccggtggggtacgtactttacgtccttcgtttaccgggaaccgttacgggggaaaccctaaacgggtcctaaccccggtttcgtttaacggggcccg

SEQ ID NO: 330272 - DNA, 549 bp, Homo sapiens
  misc_feature: GZ8MTXP02G4FEB.2.76.G10.1.454.CMB.2.raw
  modified_base (219)..(219): a, c, t, g, unknown or other
  misc_feature (219)..(219): n is a, c, g, or t
  modified_base (343)..(343): a, c, t, g, unknown or other
  misc_feature (343)..(343): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgtctggaggcacctccaacatcgggcgtgataatgtgtactggtacaagcaggtcccaggaaccgacccccaaatcctcatctctcaacaataatcagccgccctnacggactccctgaccgattctctcgccctccaagtcccgacacctcacgccctcctggcccatccaggtcgggcctccgggggaccaggactggacgggtctaggtaatttacttacgtgtgacgtagggatggggatacggaactaccgtggggtatcttactctcgttacggaacgtcggacacggtccaccgttcgtggtacc

SEQ ID NO: 330273 - DNA, 606 bp, Homo sapiens
  misc_feature: GZ8MTXP02II65I.2.76.G10.1.454.CMB.2.raw
  modified_base (221)..(221): a, c, t, g, unknown or other
  misc_feature (221)..(221): n is a, c, g, or t
  modified_base (400)..(400): a, c, t, g, unknown or other
  misc_feature (400)..(400): n is a, c, g, or t
  modified_base (503)..(503): a, c, t, g, unknown or other
  misc_feature (503)..(503): n is a, c, g, or t
  modified_base (536)..(536): a, c, t, g, unknown or other
  misc_feature (536)..(536): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccggnaggagggtcaccatctcttgttctggaggcacctccaacatcgggctgataatgtgtactggtacaagcaggtccccaaggaacccgaaccccccaaaatccctacaactcctactacaaacaaataaacgtcaacggcccggcccctcgaaggtacgtcccctagacccgtatttccnctcgccctaccgaaacgtcccggactaccctcacgcccctcccgtggacccatccgaggtcgggcctccggggaccgaggatggaggctaggaattagtacgngtgacgaggagtgggatcgaacgtacgtgggtntactttacgtcttaccgttacggaacccgtaggggaaccctaacggtcccacccggttcgtttcggaccg

SEQ ID NO: 330274 - DNA, 581 bp, Homo sapiens
  misc_feature: GZ8MTXP02JIWEN.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtactgggcccagtctgtgctgactcagccaccctcagcgtctcgggtcccccgggnaggagggtcaccatctcttgttctggaggcacctccaacagtcgggcgtgataatgtgtactggtacaagcacggtcccaaggaaccgacccccaaactcctcactctctacacaataaatcacgccgccctcaggactccctgacccgtattcctctcgccctaccaacggtcccggaccacctccacgccctccctggcccatccgaggtcgggcctccggggccgaggagtggaggctggtattagttactgtgcgaggtatggggactacggaacgaaccgtggggtctactttacgtccgtcgttccggaaccgttacggggaaccctagggtcccaccggtttcgtcgggtaccc

SEQ ID NO: 330275 - DNA, 555 bp, Homo sapiens
  misc_feature: GZ8MTXP02G3V64.2.76.G10.1.454.CMB.2.raw
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (397)..(397): a, c, t, g, unknown or other
  misc_feature (397)..(397): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgttctggagcacctcaanatcgggctgataatgtgtactggtacaagcaggtcccagtaaccgacccccaaatcctcatctctcaacaataatcagccgccctcgaggactccctgacccgtattctctcgcctaccaagtcccgcacctcacgcctcccngccatcgagtcgggccgtccggggaccgaggagtcggagggtcctaggaactttattacgtggtgcgaggagtgggatacgacgtaaccgtgggtgtactttacgtccttcgttcggaaccgtcgggaacctaacggtccaccgttccgtttggaccg

SEQ ID NO: 330276 - DNA, 661 bp, Homo sapiens
  misc_feature: GZ8MTXP02HVV29.2.76.G10.1.454.CMB.2.raw
tcagacgctcgacacacgaccggtgctcgatttagtcactcatacagggggagagatctgggggaagctcagcttcagctgtggtagagaagacaggattcaggacagtctctagcatggccggcttccctctcctcctcaccctcctcactcactgtgcagggtcctgggcccagtctgtgctgactcagccaccctcagcgtctcgggtcccccgggcagagggtcaccatctcttgttctggagcacctcaacatcgggctgataatgtgtactggtacaagcaggtcccaggaaccgacccccaaatcctcatctctcacaataatcacgcgccctcacggtacgtccccagacccgtatttcctcgtcgccccttaccgaaacgttcccggacctaccctccacgtcccctcccgtcggccctacgttccgaacggttccggggaccgtccccgggggcccgaacggggtattcggggaacgggtccttagggtaacctttaagtttaccgtggttacggacggtaggtaggtagggtagtacgtaaccgtaaaccggtacgggtacggttacgttacgttccgttaccgttaccggtaacccggtaccgggtaaccggtaaccggtaccgtacccggttaccgtttacggtaccg

SEQ ID NO: 330277 - DNA, 598 bp, Homo sapiens
  misc_feature: GZ8MTXP02IZ8QY.2.76.G10.1.454.CMB.2.raw
  modified_base (220)..(220): a, c, t, g, unknown or other
  misc_feature (220)..(220): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttctggaggcacctccaacatcgggctgataatgtgtactggtacaagcaggtcctaggaaccgacccccaaatcctcatctctcaacaataatcacgccgccctnaggactcccngacccattccnctcgcccttacaacgtcccgacaccctcacgtccctccctgccatcaggtcgggcctccgggccgaggagtgaggctggtatttagttacgtgtcgcgaggtagtggggattcggaactaaacccggttgggggtactaccgtttatcccgtttacgttcccggggtaacccgttagggggaacccctaaacggggttcccgtaaccccggtttccgtttaaggtaccccgg

SEQ ID NO: 330278 - DNA, 560 bp, Homo sapiens
  misc_feature: GZ8MTXP02HZ0ET.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggacggcacctccaacagtcgggctgataatgtgtactggtacagcaggtcccaggaaccgacccccaaatcctcactctctacacaaataatcacgccgccctgaggacgtccctgaccgtattctctcgccctcaacgtcccgcacctcacgccctcccgtcgaccactcgaggtcgggccgtcccgggaccgaggacgtggaggcttgtattacgttacgtgttgcgaggtatgggattcgaacctaacggtgggtacgtactttacgtcttcgttcggaaccgtcggaaccacggtccaccggttcttcggacc

SEQ ID NO: 330279 - DNA, 531 bp, Homo sapiens
  misc_feature: GZ8MTXP02JE3V7.2.76.G10.1.454.CMB.2.raw
  modified_base (218)..(218): a, c, t, g, unknown or other
  misc_feature (218)..(218): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgtctggaggcacctcaacatcgggcgtgataatgtgtactggtacaagcaggtcccaggaaccgacccccaaatcctcatctctcacaataatcacgccggccctcaggactcccctgacccgattcctctgccctccaagtcccggcacctcacgccctcctggcccatcaggtgggcctccgggccgaggatgaggctggattagttacngtcgngagagnggagtacgacgacgtcggtcgtacgttactcgtcgtcgtcgtacggacgtacgtacgtaccgtcgtacgtcg

SEQ ID NO: 330280 - DNA, 640 bp, Homo sapiens
  misc_feature: GZ8MTXP02G612U.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttctggaggcacctccaacagtcggcgtgataatgtgtactggtacaagcacggtcccaggaaccgacccccaaaactccctcactctctacaactaaataactcaacgccggacccctcgaacgggtacgtcccctagacccgtattcctctcgcccttaccgaacgtcccggccaacctccacgcccctcccgtcggcccacgtccgtaggtcgggcccgtcccggggaccggagggactcgggaaggtccgttaggtaactttacgttacgtggtagacggtaggagtggggattacggaaccgtaccggttggggtactcgtttaacgtccgttacgtttaccgggaaccgttcggggaacccttaacgggtccctaccggttccgttcggtacccg

SEQ ID NO: 330281 - DNA, 546 bp, Homo sapiens
  misc_feature: GZ8MTXP02G660U.2.76.G10.1.454.CMB.2.raw
  modified_base (219)..(219): a, c, t, g, unknown or other
  misc_feature (219)..(219): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgtctggagcacctccaacatcgggctgataatgtgtactggtacaagcaggtcccaggaaccgacccccaaatcctcatctctcacaataatcacgccggcccctcaggacgtccctgacccgtattcctcctcgccccttacaaacgtccccggcaccctcacgccctcccgtgccatcgagtcgggcctcccggggcgaggntggagctgattagtactgtcgngaggagtgggatgaccacgtgggtnacgtttacncgttcgttcggaaccgttgggaacctaggtcctaccgtcgttcggaccg

SEQ ID NO: 330282 - DNA, 634 bp, Homo sapiens
  misc_feature: GZ8MTXP02JHRWM.2.76.G10.1.454.CMB.2.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
tcagacgctcgacacacgaccggtgctcgatttagtcactcatacagggggagagatctgggggaagctcagcttcagctgtggtagataagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgtctggagcacctcaacntcgggctgataatgtgtactggtacaagcaggtcccaggaaccgaccccaaactcctcactctctcaacaataatcagccgccctnagggctccctgaccgtnttctctcgcctacgacgtcccgacaccctcacgcccctcccgtacgccctatccgacgggtcggggcccgtacccgggggaccggaagggtacgtcgggacggtacgtacgttaacgtttaacgtttacgttacggtcggtacgtaggtaggtagggtacggtacggtaacgtaaccggttacgggtcggttacgtttacgttaccgttaccgttaccggtaaccggtacgggtaaccggtaacggtaccgtacccggttaccggttacggtaccg

SEQ ID NO: 330283 - DNA, 534 bp, Homo sapiens
  misc_feature: GZ8MTXP02JRXT1.2.76.G10.1.454.CMB.2.raw
  modified_base (219)..(219): a, c, t, g, unknown or other
  misc_feature (219)..(219): n is a, c, g, or t
  modified_base (314)..(314): a, c, t, g, unknown or other
  misc_feature (314)..(314): n is a, c, g, or t
  modified_base (489)..(489): a, c, t, g, unknown or other
  misc_feature (489)..(489): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgttctggagcacctccaacatcgggctgataatgtgtactggtacaagcaggtcccaggaaccgacccccaaatccncatctctcaacaataatcagccgccctacaggtacgtccctgacccgtattcctctcgccctaccgaagtcccggcaccctcagccctcctcgcatcagtcggctccgggccgaggatggagctagtattactacgtgtgcaggtatgggatacgacaaccgtgggactcttacncttcgttcggaactggggaacctagggtccacgttccttaggtcc

SEQ ID NO: 330284 - DNA, 570 bp, Homo sapiens
  misc_feature: GZ8MTXP02JHMG1.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggaggcacctccaacatcgggcgtgataatgtgtactggtacaagcaggtcccaggaaccgaccccaaatcctcatctctcaacaataatcacgccgaccctcaggctccctgaccgtattctctcgcctcaagtcccgcacctcagccctcctgccatcagtgggcctccgggcgaggatggacggctggaatttagtactggtcgcagggtatggggaattcggaaacctaccggtgggggtctactttacgtccgttcgttaccgggaaccgttcggggaacccctaaaggggtccctaacccggttccgtttacgggtaacccg

SEQ ID NO: 330285 - DNA, 549 bp, Homo sapiens
  misc_feature: GZ8MTXP02HLE6E.2.76.G10.1.454.CMB.2.raw
  modified_base (219)..(219): a, c, t, g, unknown or other
  misc_feature (219)..(219): n is a, c, g, or t
  modified_base (351)..(351): a, c, t, g, unknown or other
  misc_feature (351)..(351): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnaggagggtcaccatctcttgttctggagcacctccaacagtcgggcgtgataatgtgtactggtaacaagcaggtcccaaggaacccaacccccaaatcctacatctctcaacaataaatcacgccgccctnaggactccctagacccgtattcctctcgccctcaaacgtcccggcacctcacgccctcctgcccatcgagtcgggcctccgggcgaggatgaggctagattactatgtgcgagagtggagtagacgaaccgtcggtggtcgttactctcgttcgtaaccgtacggtaccgtacggtacgtaccgtaccgttacgtccg

SEQ ID NO: 330286 - DNA, 504 bp, Homo sapiens
  misc_feature: GZ8MTXP02JYJLG.2.76.G10.1.454.CMB.2.raw
  modified_base (284)..(284): a, c, t, g, unknown or other
  misc_feature (284)..(284): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
  modified_base (491)..(504): a, c, t, g, unknown or other
  misc_feature (491)..(504): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcaggggtccctgaccgattctctgcctccaagtctggcacgtcagccttctggacntccgtggcctcagtctgcggatgaggcttgtttatttctgttcagcacgggatcgccagccggaatggacaagttggggtattcgggcggaggggaccaaggttcgaccgtcctagtcacgcccgaaggctcgccccctcggtcacctctcgttccccncccttcctctgtcgngtcgtctggagcgggctggcgaggcgcagtagnnnnnnnnnnnnnn

SEQ ID NO: 330287 - DNA, 585 bp, Homo sapiens
  misc_feature: GZ8MTXP02JKCCF.2.76.G10.1.454.CMB.2.raw
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtcccccgggcaggacgggtccaccatctcttgttcgtggaggcacctccaacagtcgggctgataatgtgtactggtacaagcaggtcccaggaaccgacccccaaatcctacatctctcaacaataatcacgccgccctacgaggcgtccctgaccgtatttctcctcgtccctacgaacgtcccgaccaccctcacgccctcctcggccatcgaggtcggccgtccggggaccgaggatcggagctaggtacttagtactggtcgacgaggtagtagggatacggacgtaaccggtggggtactcgtttactccgttccgtacggtaaccgtcgggaacctacgggtcccgtaccgtcgtttcggaacccg

SEQ ID NO: 330288 - DNA, 610 bp, Homo sapiens
  misc_feature: GZ8MTXP02IL0FN.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnaggagggtcaccatctcttgttctggagcacctccaacatcgggctgataatgtgtactggtacaagcaggtcccaggaaaccacccccaaaatcctcatcctctacaacaataaactcaacgccggccctcgacggactcccctagacccgtatttcctacgttcgcccttaccgaaacgttcccggcaccctcacgtccctccctcggcccatcacggtcggggcctcccgggccggaggacgtggacggctaggtatttagttaccgtggtgacgaggtagtgggaattcgaacgtaaccgtggggtctactttacgtccgttcgtaccgggtaaccgttacggggaaccctaaaggggtccctaacccggttccgtttcggacccg

SEQ ID NO: 330289 - DNA, 548 bp, Homo sapiens
  misc_feature: GZ8MTXP02GH576.2.76.G10.1.454.CMB.2.raw
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccctgggcagaggtcaccatctcttgttctggaggcacctccaacatcgggctgataatgtgtactggtacaagcaggtcccaggaaccacccccaaactcctcatctctcaacaatatccagccgccctagaggacgtccctgaccgattcctctcgccctaccaagtcccgcaccctcacgccctccctgcccatcgagtcggctccgggcaggactgagctgacttatactgtcgcagggatggggatcggaactaaccgtggggtctacgttactcgtcgttaaccggaccttacgggggaaccctaagggtccaacccggttcgtttacggg

SEQ ID NO: 330290 - DNA, 640 bp, Homo sapiens
  misc_feature: GZ8MTXP02HNJ69.2.76.G10.1.454.CMB.2.raw
  modified_base (220)..(220): a, c, t, g, unknown or other
  misc_feature (220)..(220): n is a, c, g, or t
  modified_base (378)..(378): a, c, t, g, unknown or other
  misc_feature (378)..(378): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctccaacagtcgggctgataatgtgtactggtacagcaggtcccaggaaccgaacccccaaactcctcatcctctacaacaataactcaacgccggccctcgaggactccccgtagcccgtactttcncttccgcccttaccgaaacggtcccggaccaccctccacgtcccctcccgtggcccacgttccgacgggttcggggcccgtccccgggggacgtacgggtagttcgggacgggtcttaggtactttaacgttaccgtggtacgtacgaggggtaagtggggaatacggtaaactaacccggttggggtactacgtttactcgtttaccgttcggtaaccggtcgggaacctaaggttccgtaccggttcgttttacggaccg

SEQ ID NO: 330291 - DNA, 619 bp, Homo sapiens
  misc_feature: GZ8MTXP02HC0UL.2.76.G10.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcacatctcttgttctggagcacctcaacntcgggctgatatgtgtactggtacaagcacggtccccaggaacccgaacccccaaactcctacactctactcaacaataactcaccgccggccctgacggtctccctgaccgtntttccnctcgccccttacacggtcccgccnccgtcaccgtccctccctcggcccagtccgaggtcgggccgtcccggggaccgaggtcgtggacggtctaggtactttaacgttcgttggacgacggtaggtacggtaggggacttacggaaccgtaaccggttggggtacttaccgttagtcccgttcggttaccggaaccgttacgggaacccgtacggtcccgtaccggttccgtttacggacccg

SEQ ID NO: 330292 - DNA, 541 bp, Homo sapiens
  misc_feature: GZ8MTXP02HIIS1.2.76.G10.1.454.CMB.2.raw
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (488)..(488): a, c, t, g, unknown or other
  misc_feature (488)..(488): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggcagaggtcaccatctcttgtctggagcacctcaacntcgggctgataatgtgtactggtacaagcaggtcccaggaccgaccccaaatccncatctctcaacaataatcagccgccctnaggactcccctgaccgtattctctcgccctacaaacgtcccgcacctccagcccctcccgtgcccatcgaggtcgggcctccggggccgaggactggaggctaggtattatacgtgtgcgaggagtgggatcgacacggtggtatcttacnctcgttcggaaccgttcggggaaccctaaggtcctacccgtcgtttacggccg

SEQ ID NO: 330293 - DNA, 513 bp, Homo sapiens
  misc_feature: GZ8MTXP02GSGWO.2.76.G10.1.454.CMB.2.raw
  modified_base (450)..(450): a, c, t, g, unknown or other
  misc_feature (450)..(450): n is a, c, g, or t
  modified_base (500)..(513): a, c, t, g, unknown or other
  misc_feature (500)..(513): n is a, c, g, or t
tcagacgctcgacacacgaccggtgctcgatttagtcactcatacagggtcctgggcccagtctgtgctgactcagccaccctcagcgtctgggcccccccgggcagagggtctccatctcttgttctggagtcacttccaacatcggaaataatgatgtgagctggtaccagcaggtcccaggaaccgcccccaaactcctcatctataccaatgatgtgccggccctcgaggggtccctgaccgattctctcgcctcaagtctggcacgtcagccttcctggacatccgtggcctccagtctgcgatgagtcttgtttattctgttcagcacgggatcgccagccgaatggactaagttggggtattcgggcggagggacctaaggttcgacccgtacgtagtcagacccaggcctcgcccccgtcggtccactccgtcgttcccccncccgttcctcgtgtcgacgtcgtcgtgcgcggctggcaggcgacagtagnnnnnnnnnnnnnn

SEQ ID NO: 330294 - DNA, 492 bp, Homo sapiens
  misc_feature: GZ8MTXP02H5MUC.2.76.G10.1.454.CMB.2.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
  modified_base (479)..(492): a, c, t, g, unknown or other
  misc_feature (479)..(492): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccgcccccaaactcctcatctataccaatgatgtgcggcctnaggggtccctgaccgattctctgcctccaagtctggcacgtcagccttcnggacatccgtggccctcagtctgcggatgaggcttgtttattctgttcagtcacgggatcgccagccggaatgggcaagttgggggtacttcgggacggaggacctaagtcgacccgtctagcagccaggctcgccccctggtccactctcgttcccgccttcctctcgtcgagcgtctgngtcggctggcaggcnagtagnnnnnnnnnnnnnn

SEQ ID NO: 330295 - DNA, 589 bp, Homo sapiens
  misc_feature: GZ8MTXP02JC3S5.2.76.G10.1.454.CMB.2.raw
  modified_base (219)..(219): a, c, t, g, unknown or other
  misc_feature (219)..(219): n is a, c, g, or t
  modified_base (343)..(343): a, c, t, g, unknown or other
  misc_feature (343)..(343): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnaggagggtcaccatctcttgtctggagcacctcaacatcgggcgtgataatgtgtactggtacaagcaggtcccaggaaccacccccaaatcctacatctctcacaataactcacgccgccctnacggactcccctgaccgtattctctcgcccttccgaaacgtcccggccaccctcacgtccctccctcgccactcgaggtcgggcctccggggccgaggacgtggaggctgggtacttagttacctgtgcagggtagtggggatacggaactaaccggtggggtactctttacgtccgttccgttacgggtaacccgtggggaaacccttacggggtacctacccggtttccgtttacgggtaaccc

SEQ ID NO: 330296 - DNA, 550 bp, Homo sapiens
  misc_feature: GZ8MTXP02G6SU3.2.76.G10.1.454.CMB.2.raw
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagaggtcaccatctcttgtctggagcacctcaacatcgggctgataatgtgtactggtacaagcaggtcccaggaaccgacccccaaaatcctcatctctcaacaataaatcacgcggcccctnaggactcccctgacccgattcctctccgcctaccaacgtccgaccacctcacgcctccctcgcactcagtcggcgtccgggaccggaggagtgaggcgtagtattattactagtgcgaggagtaggagtacgacgaacgtacggtgtacttacttcttcgttacgtaaccgtacggaacgaacggtacgtaccgttccgttacgtacg

SEQ ID NO: 330297 - DNA, 553 bp, Homo sapiens
  misc_feature: GZ8MTXP02IJCBY.2.76.G10.1.454.CMB.2.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (492)..(492): a, c, t, g, unknown or other
  misc_feature (492)..(492): n is a, c, g, or t
  modified_base (539)..(553): a, c, t, g, unknown or other
  misc_feature (539)..(553): n is a, c, g, or t
tcagacgctcgacacacgaccggtgctcgatttagtcactcatacagggtcctgggcccagtctgtgctgactcagccaccctcagcgtctgggcccccccgggcagagggtctccatctcttgttctggagtcacttccaacatcggaaataatgatgtgagctggtaccagcaggtcccaggaaccgccccccaaactcctcatctataccaatgatgtgcggccctgaggggtcccctgaccgtattctctgccctccaagtctggcacgtcagccttcnggacatccgngccctcagtctgcgatggagtcttgtttatttctgttcagcagggtntcgaccagccgaatggactaagttggggtattcggggacgggtaacggaccgtaaggttcgacccgttaccgtaagtcacgacccgaaggccgtccgccccccgttcggtcctaccgtctccgttcccccaccccttcctccgtcgtaccgngtccgtcgtggacggcgggtcgtcggacgaacgggcgacgagtacgnnnnnnnnnnnnnnn

SEQ ID NO: 330298 - DNA, 575 bp, Homo sapiens
  misc_feature: GZ8MTXP02JY1S4.2.76.G10.1.454.CMB.2.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (454)..(454): a, c, t, g, unknown or other
  misc_feature (454)..(454): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctccaacntcgggcgtgataatgtgtactggtaacaagcaggtccccaggaaccgaccccaaactcctacatcctctcaacaataactcacgtccggccctacgacggactcccctagacccgtattcctctcgccctacgaaacgtcccgctaccctnaccgccctcccgngccatcgaggtcggccgtccgggaccgaagggngtggagctagtattacgtacgtgcgacgaggtagtggactacgaacgtacggtggtctacttacgtcgttacgtaccggaaccgtacggaaccgtacggtcccgtaccgttcgtcggaccg

SEQ ID NO: 330299 - DNA, 685 bp, Homo sapiens
  misc_feature: GZ8MTXP02HCDX3.2.76.G10.1.454.CMB.2.raw
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctcaacngtcgggctgataatgtgtactggtacaagcaggtaccccaggaaccgacccccaaactcctacactctctacaactaataactcaaccgccggcccctacgacggtacgttcccctaggacccgtatttcctcctccgccccttaccgaaacgtccccgggacctaccctaccgaccgccccttcccgcgggaccctaacgttccgaacgggttccgggggcccgtacccgggggacccggtaagggtacgtacgggaacgggtcttagggtaattttacttacggtggtacgacgtagggtagttagggggaattacggaacccgtaaacggtttgggggtacttacctttagttccgttaccggtttaccgggaaccgttcgggaaccgtaaacggttcccgaacccggttcgtttacgggacccg

SEQ ID NO: 330300 - DNA, 597 bp, Homo sapiens
  misc_feature: GZ8MTXP02HH00J.2.76.G10.1.454.CMB.2.raw
  modified_base (219)..(219): a, c, t, g, unknown or other
  misc_feature (219)..(219): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (431)..(431): a, c, t, g, unknown or other
  misc_feature (431)..(431): n is a, c, g, or t
tcagacgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnaggagggtcaccatctcttgttctggaggcacctccaacatcgggcgtgataatgtgtactggtacaagcaggtcccaggaaccgaccccaaactcctcatctcncacaatactcacgcgccctcaggactcccngaccgtattcnctgccctccaagtcccgacacctcacgccctccctgccactcgagtcgggccgtccgggccgaggntggaggctggatttacgttacgtggttcgcaagggtagtggggaattacgaccgtaaccgttggggtcgtactttaacgtccgttccggtttaccgggaacccgttacgggggaaacccgtaaacggggttccctaaccccgggttccgttttaacggggtacccg

SEQ ID NO: 330301 - DNA, 567 bp, Homo sapiens
  misc_feature: GZ8MTXP02GZ625.2.76.G10.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccgggnaggagggtcaccatctcttgttctggagcacctccaacngtcgggcgtgataatgtgtactggtacaagcaggtcccaaggaaccaccccaatccncatctctcaacaatatcacgccgccctgaggactccctgaccgtattctctcgccctacaacgtcccgcacctcacgcctccgtgccatcgagtcgggaccgtccgggcgaggactggagtctgtattacgtacgtggtgcgaggtagtgggatacggaactacggttggggtctacgtttacgtccgttcggtttacggaacccgtcgggaaacctaacgggtcccaaccggttcccgttggtacccg

SEQ ID NO: 330302 - DNA, 576 bp, Homo sapiens
  misc_feature: GZ8MTXP02FQIVK.2.76.G10.1.454.CMB.2.raw
  modified_base (220)..(220): a, c, t, g, unknown or other
  misc_feature (220)..(220): n is a, c, g, or t
  modified_base (351)..(351): a, c, t, g, unknown or other
  misc_feature (351)..(351): n is a, c, g, or t
  modified_base (424)..(424): a, c, t, g, unknown or other
  misc_feature (424)..(424): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtccccggnaggaggtcaccatctcttagttctggaggccacctccaacagtcgggctagataatgtagtactggtaacagcgacggtaccccgaaggaacccgaaccccctaaactcctacatcctctacaacaatacncacgccgcctgagactcctagactcttctactcgccctacgaacgtcccgaccacctcacgcctccgtgaccntcgacgtcgggccgtccgggaccgaggacgtcggacggtctaggtaactttacgttacgtggtcgacgaggtagtgggatacgtacgacggttgggtactcttacgtctcgttacgaacgtacggacctacggtcctacgtcgttacgaccg

SEQ ID NO: 330303 - DNA, 638 bp, Homo sapiens
  misc_feature: GZ8MTXP02GXHO0.2.76.G10.1.454.CMB.2.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccgggnaggagggtcaccatctcttgttctggagcacctcaacntcgggctgataatgtgtactggtacaagcacggtcccaaggaacccgacccccaaatcctcatctactcaactaataatcacgccggccctagacggactccctagacccgtattctctcgccccttacgaacggtcccgaccaccctccacgcccctcccgtggaccctacgtccgacgggtcgggcccgtcccggggaccggagggtactcgggacgggtcttaggtaactttaacgttacgtggttcgacgtagggtagtggggaattacggaacgtaccggttgggtacttctttaacgtccgttcggtttaccgggaaccgttacggggaaacccgtaacggttcccgtacccggtttccgtttcgggtacccg

SEQ ID NO: 330304 - DNA, 677 bp, Homo sapiens
  misc_feature: GZ8MTXP02JTB00.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnaggagggtcaccatctcttgttctggagcacctccaacatcgggctgataatgtagtactggtaacaagcaggtcccaaggaaccgaacccccaaatcccacactcctctacaactaataactcaaccggccgcccctcgacggtacgtcccctagacccgtacttctccttcgcccttacccgaaacgttcccccgggactaaccccgttcaccgtcccccttcccgtacggccctacgtcgtacgggttcggggcccgtcccgggggacccgagggtatcgggaagggtccttagggtaaactttacgttaccgtggtacggtacgtaagggtagtacgggggacttacggaaccgtaaccggtgggggttactaccgtttacgtccgttccggttacgggaacccgttcgggaaaccgtacggtacccgtacccggttccggttaggtaccccg

SEQ ID NO: 330305 - DNA, 607 bp, Homo sapiens
  misc_feature: GZ8MTXP02HGJ4V.2.76.G10.1.454.CMB.2.raw
  modified_base (220)..(220): a, c, t, g, unknown or other
  misc_feature (220)..(220): n is a, c, g, or t
  modified_base (458)..(458): a, c, t, g, unknown or other
  misc_feature (458)..(458): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagaggtcaccatctcttgtctggagcacctcaacatcgggctgataatgtgtactggtacaagcaggtcccaaggaaccgacccccaaactcctcactctctcaacaataactcaccgccggccctcgacggacgtcccctgacccgtactttctactcgacccttccgaaacggttcccggcaccctcacgcccctcccgtggcccatccgaggtcgggccgtccggggaccgaggntggacggtctaggtaacttacgttacgtgtacggcgaaggtgtaggggattcggaaaccgtaaccggtggggtagtctttacgtccttcggtaccggtaaccgttacggggaaccctaacggtccctaccggttccgtttacggacccg

SEQ ID NO: 330306 - DNA, 772 bp, Homo sapiens
  misc_feature: GZ8MTXP02IU93W.2.76.G10.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttcctctcctcctcaccctcctcactcactgtgcagggtcctgggcccagtctgtgctgactcacgccaccctcagcgtcgtcgggtccccggnagaggtcactntctnttgtctggacgcacctcaacngtcgggcgtagatatgtagtacgtggtaacagcgacggtacccaacggaaccccaaccccctaaactccctactacttcctactaccaaactaaactaactccgaaccggccccgtacccctacgaacgggtaccgttcccccgttacggacccgttactttccctcccgttaccgtacccccgttaaccggtaaaccggggttcccccggaccctaacccgtccgaacccgttcccccgttaccccggtacgggtacccctaaccggttccggtaaccgggggttcccgggggtacccgggtccccgggggacccgggtaaaacggggttcggtacgggtacggttcccgttaaggttaaccttttaaccgtttagtcgggttcgaacgggtaagggtaacggtacgggtaactaacggaaccgttaaccgggttgggttaaacgttctttacgtccgttacggtacggaacggtacggaaccgtacggtccctaccggtttcgtacggtacccg

SEQ ID NO: 330307 - DNA, 578 bp, Homo sapiens
  misc_feature: GZ8MTXP02IBURE.2.76.G10.1.454.CMB.2.raw
  modified_base (219)..(219): a, c, t, g, unknown or other
  misc_feature (219)..(219): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgtagggtcctgggcccagtctgtgctgactcagccaccctcagcgtctcgggtcccccggnagagggtcacatctcttgttctggagcacctcaacatcggctgataatgtgtactggtacaagcaggtcccagaaccgaacccccaaactcctacacttctctcacaaataatcagcccgccctcaggctccctgacctnttcnctcgccctccaagtccgcaccctcacgccctcctggcccatcgaggtcggccgtcccgggcgacggagtcggagggtctaggtatttacgttaccgtggtcgacgaagggagtggggattacggaacctaccggttggggtacttacgttacgtccgttacgttccggaccgtaacgggaaccctacggtcctacccggttcgttacgaccgacg

SEQ ID NO: 330308 - DNA, 697 bp, Homo sapiens
  misc_feature: GZ8MTXP02GVZ2I.2.76.G10.1.454.CMB.2.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtccaccatctcttgttctggagcacctcaacngtcgggcgtgataatgtgtactggtacagcaggtcccaggaaccacccccaaatcctcatctctcaactaatactcacgccgccctacgacggacgtcccctagacccgtatttcctcgtcgacccccttaccgaaacggtccccggaccacccgttccaaccgtcccccttccccgtcgggaccccaacgttccggtaacgggttccgggggacccgttccccgggggaccggacgggtacgtacgggaacgggtccttagggtaaatttaacgttaccgtggttaggaccgtaggggtaagtgggggtaacttacggaaccgtaaccgggttgggggttactaccgtttacgtccgtttcggttaccgggtaacccggttacggggtaacccgtaaacgggttcccgtacccggtttcccggtttcgggtaaccccg

SEQ ID NO: 330309 - DNA, 541 bp, Homo sapiens
  misc_feature: GZ8MTXP02HXZ5O.2.76.G10.1.454.CMB.2.raw
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (339)..(339): a, c, t, g, unknown or other
  misc_feature (339)..(339): n is a, c, g, or t
  modified_base (440)..(440): a, c, t, g, unknown or other
  misc_feature (440)..(440): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggccccagtctgtgctgactcagccaccctcagcgtctgggtcccccggnagaggtcaccatctcttgtctggagcacctcaacntcgggctgataatgtgtactggtacaagcaggtcccaggaaccgacccccaaatcctcatctctcacaataatcagccgcccctnaggactcccctgaccgtattcctctcgccctccaagtcccggcacctcacgccctccctgcccatcagtcgggctccgggcaggatggagctgattatacngtgcaggagtgggatgaagttaaccgtgggtcgtactttagtccttcgttacggaaccgtcggggaaccctaacgggtcctacccgttcgtttaggacccg

SEQ ID NO: 330310 - DNA, 605 bp, Homo sapiens
  misc_feature: GZ8MTXP02F6IH7.2.76.G10.1.454.CMB.2.raw
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (445)..(445): a, c, t, g, unknown or other
  misc_feature (445)..(445): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtccccggnagagggtcaccatctcttgttctggagcacctccaantcgggctgataatgtgtactggtacagcaggtcccaggaaccgacccccaaatccctanactctctcaacaatactcacgccgccctgaggctccctgaccgtattctctcgccctccaaacggtcccgaccaccctcacgccctcccgtggcccacgtcacggtcgggccgtccggggaccggaggntcggaggcctggaatttactacgtgtagcgaagggagtagggatacggaaccgtaaccggttgggggtacttaccgtttaacgtccgttccgttaccggtaacccggttacggggaaccgtaacggtcccgtaaccggtttccggttacgggttaacccg

SEQ ID NO: 330311 - DNA, 614 bp, Homo sapiens
  misc_feature: GZ8MTXP02GJ4NH.2.76.G10.1.454.CMB.2.raw
  modified_base (221)..(221): a, c, t, g, unknown or other
  misc_feature (221)..(221): n is a, c, g, or t
  modified_base (345)..(345): a, c, t, g, unknown or other
  misc_feature (345)..(345): n is a, c, g, or t
  modified_base (464)..(464): a, c, t, g, unknown or other
  misc_feature (464)..(464): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnaggagggtccaccatctcttgtctggagcacctcaacatcggctgatatgtgtactggtacagcaggtcccaaggaaccacccccaaatcctcactctctacaacaataatcacgccggccctnacggcgtcccagccgtattcctctcgccctcgaacgtcccgccaccgtcacgccctccgtgccactcgagtcgggccgccgggaccgaggactggaggtcctaggtaattacgttacgnggttacgacgtagggagttacgggggattacggaaaccgtaccgggttgggggtaacgtctttacgtccgtttccggtttacccggaaccggttacggggtaacccgtaacgggtcccgttaccccggttaccgtttacggggtaacccg

SEQ ID NO: 330312 - DNA, 539 bp, Homo sapiens
  misc_feature: GZ8MTXP02JKD7B.2.76.G10.1.454.CMB.2.raw
  modified_base (220)..(220): a, c, t, g, unknown or other
  misc_feature (220)..(220): n is a, c, g, or t
  modified_base (315)..(315): a, c, t, g, unknown or other
  misc_feature (315)..(315): n is a, c, g, or t
  modified_base (488)..(488): a, c, t, g, unknown or other
  misc_feature (488)..(488): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagaggtcaccatctcttgttctggaggcacctccaacatcgggcgtgataatgtgtactggtacaagcaggtcccaggaaccacccccaaatccncatctctcacaataactcacgcggcccctcgaggactcccctgacccgtattctctcgccctccgaacgtcccggcacctcacgccctccctggccatcgagtcgggctccggggccgaggagtggaggctggatttacttacgtgtgcaggagtgggatcgacacgtgggtntcgttatctcgttcggaaccgttggacctacggtccaccgtcgttggtacg

SEQ ID NO: 330313 - DNA, 557 bp, Homo sapiens
  misc_feature: GZ8MTXP02JG4JQ.2.76.G10.1.454.CMB.2.raw
  modified_base (256)..(256): a, c, t, g, unknown or other
  misc_feature (256)..(256): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgtctggagcacctcaacntcgggcgtgataatgtgtactggtacaagcaggtccaggaaccgaccccaaactcctcatctctcacaataatcacgcgcctcaggctccctgccgattctctcgcctaccaacgtcccggcaccctcacgtccctccctcggacccagtccaggttcgggccgtccggggccgaggatcggacggctaggacttagttactgtgcgaggacgtgggactcgactaccgtggggtactcttacgtcctcgttaccggccgtacggggaacctacgggtccaccggtttccgtacggtaccg

SEQ ID NO: 330314 - DNA, 704 bp, Homo sapiens
  misc_feature: GZ8MTXP02IOU8P.2.76.G10.1.454.CMB.2.raw
  modified_base (218)..(218): a, c, t, g, unknown or other
  misc_feature (218)..(218): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctcgggtcccccggnagaggtcacatctcttgtctggagcacctccaacatcggcgtgataatgtgtactggtacaagcaggtcccaggaaccgacccccaaatcctcactcctctcaacaataaatcaagccggccctcgaggactcccctgaccgattctcctcgcccctacgaacgtcccggcctacctccacgtccctccccgtggaccctacgttcgaacgggttcgggggcccttccccggggggaccgtaacgggggtaactacgggacgggggtaccctttagggtaaacttttaacgtttaccgttaagggttcggacccggtaaggggtaacgttagggggaactttacgggaaaacccttaaacccgggttcgggggttaactcccggttttaaactacccgtttcggttttaccgggaaccgtttaccgggggaaacccttaacgggggttaccctaaacccggtttcccgtttacggggtaaaccccg

SEQ ID NO: 330315 - DNA, 560 bp, Homo sapiens
  misc_feature: GZ8MTXP02GYGCL.2.76.G10.1.454.CMB.2.raw
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggaggcacctccaacntcgggcgtgataatgtgtactggtacaagcaggtccccaggaaccgaccccaaatcctcatctctcacaataatcagccgcctnaggactcccngaccgnttcnctgccctcgaagtccggcacctcacgccctccctgcccancaggtcgggccgtacccgggcgaggatcggaggctagtagttattacgtggtgacgaggagtgggatcggaacgacgtggggtctactttagtccttcgttaccggaaccgtcggggaacccgtaacggggtccacccggtttcgtttcgggaaccg

SEQ ID NO: 330316 - DNA, 562 bp, Homo sapiens
  misc_feature: GZ8MTXP02FZWIK.2.76.G10.1.454.CMB.2.raw
  modified_base (256)..(256): a, c, t, g, unknown or other
  misc_feature (256)..(256): n is a, c, g, or t
  modified_base (342)..(342): a, c, t, g, unknown or other
  misc_feature (342)..(342): n is a, c, g, or t
  modified_base (494)..(494): a, c, t, g, unknown or other
  misc_feature (494)..(494): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggagcacctcaanatcgggctgataatgtgtactggtacaagcaggtcccaggaaccgacccccaaactcctcatctctcacaataatcagccgccctnaggactccctgaccgtattctctcgccctaccaagtcccggcaccctcacgccctccctgcccatcaggtcggcctccgggacgtaggatggaggctaggatttacgttacgtgtgacgaggaattggggatacgggaacaaccggttgggntacgtttactccgtcgtttacggaaccgttcggggaacctaacgggtcctaccggtcctttagggacc

SEQ ID NO: 330317 - DNA, 588 bp, Homo sapiens
  misc_feature: GZ8MTXP02GCAGU.2.76.G10.1.454.CMB.2.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtccccggnagagggtcaccatctcttgttctggagcacctcaacntcgggctgataatgtgtactggtaacaagcaggtcccaaggaaccgacccccaaatcctacatcctctcaacaataactcacgccgccctgacggctccctgaccgtattctctcgccctacaacgtcccgacacctcacgccctcccgtgaccctatcgacgggtcgggccgtcccggggccggaaggagtgggaacggtctagtaacttacttacgtgtcgacgaggtagtggggaatacggaactaaccggtgggtctacgttactccgtcgttaccgggaacgttcgggggaaacctacgggtcctaccggttcgtttacggaccg

SEQ ID NO: 330318 - DNA, 620 bp, Homo sapiens
  misc_feature: GZ8MTXP02J0SR1.2.76.G10.1.454.CMB.2.raw
  modified_base (223)..(223): a, c, t, g, unknown or other
  misc_feature (223)..(223): n is a, c, g, or t
  modified_base (508)..(508): a, c, t, g, unknown or other
  misc_feature (508)..(508): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtccccccgggnaggacgggtcaccatctcttgttctggacgcacctccaacagtcgggctgataatgtgtactggtacaagcacggtcccaaggaacccaacccccaaactccacatctctcaacaaataatcacgccgcctacgacggactccctcgaccgtatttcctccgtcgccctaccgaacgtcccggacctacccgtcaccgtcccctcccgtcggccctacgtcgacggttcgggcccgtccggggaccgaggcgtggaggctaggtactttagtctggtgacgaggntaggggattacggaaccgtaccggtggggttactactttacgtccgttccggtttaccggaaccgttacggggaaccctaagggtccctacccggtttcgtacgggtacccg

SEQ ID NO: 330319 - DNA, 531 bp, Homo sapiens
  misc_feature: GZ8MTXP02IDZT0.2.76.G10.1.454.CMB.2.raw
  modified_base (220)..(220): a, c, t, g, unknown or other
  misc_feature (220)..(220): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgtctggagcacctccaacatcgggctgataatgtgtactggtacagcaggtcccaggaaccgacccccaaatccncatctcncacaataancagcgccctnacggntcccngccgattcnctgccctcagtcccgcactcagcctccctgccatcagtcggcgtcggcgaggntgaggctgattactactgtgcgaggngtgggatcggactaaaccgtgggtcgactttacgccttcgttaccggaaccgtcggggaaccctaacggtccgaccgtttccgtttacggcccg

SEQ ID NO: 330320 - DNA, 621 bp, Homo sapiens
  misc_feature: GZ8MTXP02GQ7DK.2.76.G10.1.454.CMB.2.raw
  modified_base (221)..(221): a, c, t, g, unknown or other
  misc_feature (221)..(221): n is a, c, g, or t
  modified_base (497)..(497): a, c, t, g, unknown or other
  misc_feature (497)..(497): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtcccccggnaggagggtcaccatctcttgttctggaggcacctccaacagtcgggcgtgataatgtgtactggtaacaagcacggtcccaaggaaccgaacccccaaaactcctacactctctacaacaataaactcaacgccggcccctagacggacgtccctagaccgtatttcctcgtcgccctaccaaacgtcccgaccacccgtcacgccctcccgtgcccatcgaggtcgggcccgtccggggaccgaggagtcggaggtcctaggtacttagttacgnggttcgacgtagggagtggggaattacggaaaccgtaaccgtggggttctacgtttactccgttcgttaccgggaaccgttacggggaacctaacggtccctaaccggttccgtttcggacccg

SEQ ID NO: 330321 - DNA, 536 bp, Homo sapiens
  misc_feature: GZ8MTXP02I2KJY.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgttctggaggcacctccaaacatcgggcgtgataatgtgtactggtacaagcaggtcccaggaacgacccccaaactcctcatctctcacaataatcagcgccctcaggacgtccctgccgtattctctcgcctcaacgtcccggcacctcacgccctccctgccatcagtcgggctccgggccgaggatggaggctgattacttactgtgcgagagtggatgataaccgtgggtagtcttatccttcgttcggaaccgtcgggaacgtacggtccgtaccgttccgttcggtacccg

SEQ ID NO: 330322 - DNA, 628 bp, Homo sapiens
  misc_feature: GZ8MTXP02JVH4H.2.76.G10.1.454.CMB.2.raw
  modified_base (220)..(220): a, c, t, g, unknown or other
  misc_feature (220)..(220): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnaggagggtcaccatctcttgttctggacggcacctccaacatcgggctgataatgtgtactgtacaagcaggtcccaggaaccaccccaaatccncatctctcaacaataactcagtccgccctcgaggactccctgaccgtatttcncttcgccctaccgaaacgtcccggcctaccctcacgtcccctcccgtggacccactccgagggtcggggcccgttcccggggacccgaggactcgggagtctaggtatttacgtacgtggtacgcgtaaggtgtggggaattacgaaaaccgtaaccggttggggtacttaccgtttaactccgttaccgttaccggaaccgtttcggggaaacccgtaaacggggttccctaaccccggtttccgttacgggtaacccg

SEQ ID NO: 330323 - DNA, 698 bp, Homo sapiens
  misc_feature: GZ8MTXP02IP5F0.2.76.G10.1.454.CMB.2.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtcgtcgggtccccggnaggagggtcaccatctcttgtctggagcacctccaacagtcgggcgtgataatgtgtactggtaacagcaggtcccaggaacccgacccccaaactcctacatctctacaacaaataactcacgccggcccctacgaacggtacgtcccccgtgacccgtatttcctactccgacccctaccgaaaccgttcccggacctaccctccacgtcccctcccgtcggacccacgttccgaagggttccgggccgtccccgggggacccgtagggacgttacgggacggtccttagggtaactttacgttaaccgttggtacggtacggaaggggtacgttagggggaacgttacggaaacccgtaaaccgggttggggtacgttacgtttaacgttcccgttccggtttaccgggaacccgtttacgggggaaaccccgtacgggttacccgtacccggtttaccggtttcggtaacccgg

SEQ ID NO: 330324 - DNA, 619 bp, Homo sapiens
  misc_feature: GZ8MTXP02FWIGN.2.76.G10.1.454.CMB.2.raw
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggcagagggtcaccatctcttgttctggagcacctccaacagtcgggctgataatgtgtactgtacaagcacggtcccaaggaaccgacccccaaactcctacactctctacaacaataactcgacgccgccctgacggactcccagccgtattctctccgccttaccgaacggtcccgactaccctcacgccctccctgacccatcgaggtcgggccgtccggggaccgaggactggacggcttaggtaatttacgttacgtggtacgacgagggtagtaggggtaactcggtaaacccgtaccggttgggggttctacctttacgtaccttcggtttaaccggaaccgttacggggaaccctaacggggttccctaaccggtttcccgttaggtaaccccg

SEQ ID NO: 330325 - DNA, 516 bp, Homo sapiens
  misc_feature: GZ8MTXP02FXLMD.2.76.G10.1.454.CMB.2.raw
  modified_base (218)..(218): a, c, t, g, unknown or other
  misc_feature (218)..(218): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccggnagagggtcaccatctctgttctggagcacctcaacatcgggctgataatgtgtactggtacaagcaggtcccaggaaccgacccccaaatcctcatctctcacaataatcacgcgccctcagactccctgccgattcctctcgcctcaagtcccgcacctcacgccctcctgccatcagtcgggctcgggccgaggactgagctgattactacgtgtgcaggagtgggatcggacaaccgtggggtatcttagtcctcgttcggaacgtcgggacctaaggtccacgtccttggaccg

SEQ ID NO: 330326 - DNA, 587 bp, Homo sapiens
  misc_feature: GZ8MTXP02FTA9U.2.76.G10.1.454.CMB.2.raw
  modified_base (347)..(347): a, c, t, g, unknown or other
  misc_feature (347)..(347): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggagcacctcaacatcgggctgataatgtgtactggtacaagcaggtcccaggaaccgacccccaaactcctcatctctacaacaataaactcacgccgccctnaggactccctgaccgtattctctcgccctacaacgtcccgcacctcacgccctcctgcccatcacggtcgggccgtcccggggaccgagggtaactcgggaacgggcttaggtaactttaacttacgtggtcggcgtaaggagtggggatacgaccgtaacggtggggtcgtactttatccgtcgtttacggaaccgttcgggggaacctaacgggtcctaccgttccgttacggtaccg

SEQ ID NO: 330327 - DNA, 668 bp, Homo sapiens
  misc_feature: GZ8MTXP02GZOJ3.2.76.G10.1.454.CMB.2.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (398)..(398): a, c, t, g, unknown or other
  misc_feature (398)..(398): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccacctcagcgtcgtcgggtcccccggnaggaggtcaccatctcttgttcgtggacgcacctccaacngtcgggctgataatgtgtacgtgtacagcgacggtcccaacggaacccaacccccaaactcctactactctcctaccaaactaagtaactcgaccgcccggtaccctacgacggtacgttcccccgtagacccgtntttcctccgtaccgtccctaccgaaccgtcccggacccacccgtccgaccgtcccctcccgtcggacctacgtcgacgggtcgggcccgtcccggggaccgtaggtacgtcggacggtcttaggttaacttacgttacgtggtcgacggtagggtacggtaggggtaacgttacggaaccgtaacgggttgggttcgtactttacgtccgttcggttacgggtaaccgtacgggtaaccgtacggtcccgtaccgtttcgtacggtaccg

SEQ ID NO: 330328 - DNA, 633 bp, Homo sapiens
  misc_feature: GZ8MTXP02JOAM4.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtctcggggtcccccgggnaggagggtcaccatctcttgtctggacgcacctccaacagtcgggctgataatgtgtactggtacaagcacggtcccaaggaacccgaacccccaaatccctcacttcctctacaaactaataactcaacggcccggccctcgaacgggactcccctagacccgtatttcctcctcgccctaccgaacgttcccggacctacctcaccgccctcccgtggccctagtcgaggtcgggaccgtcccgggggccgaagggtacgtcggacgggtcttagggtaactttacgttacgtggtcgacgagggtagtggggattacggaacctaacggtggggtatactttacgtcgttccgttacggaaccgttagggaacccgtaacggtcctacccggtttcgttcggaaccg

SEQ ID NO: 330329 - DNA, 556 bp, Homo sapiens
  misc_feature: GZ8MTXP02JR7IX.2.76.G10.1.454.CMB.2.raw
  modified_base (219)..(219): a, c, t, g, unknown or other
  misc_feature (219)..(219): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (539)..(539): a, c, t, g, unknown or other
  misc_feature (539)..(539): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccatctcttgttctggagcacctccaacatcgggctgataagtgtgtactggtacaagcaggtcccaggaccaccccaatccnatcnctcacaatancagccgcctnaggacgtcccngccgattctctgcctcagtcccggcacctcacgccctccctgcccatcacggtgggccgtccggggaccgaggactggacgtcttaggaatttagttacctggtcgcgaagggtagtggggaatcggaactaaccggttggggtacgtctttactcgttccgtacgggaaccgttggggaaccctaggtaccnccggttcctttggaccc

SEQ ID NO: 330330 - DNA, 619 bp, Homo sapiens
  misc_feature: GZ8MTXP02JWHT6.2.76.G10.1.454.CMB.2.raw
  modified_base (220)..(220): a, c, t, g, unknown or other
  misc_feature (220)..(220): n is a, c, g, or t
  modified_base (353)..(353): a, c, t, g, unknown or other
  misc_feature (353)..(353): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctcttgttctggagcacctccaacatcgggctgataatgtgtactggtacaagcaggtccccaaggaaccaccccaatcctcatctctcaacaatactcacgccgcctcgaggactcccngaccgtattctctcgcctaccgaacgtcccggacacccgtcacgtccctccctggccctatccgaggtcgggccgtcccggggacggaggactgggacggtctaggtaatttacgttaccgtggtacggacgtaagggtacgtaggggaacttacgggaaacctaaccgggttggggtacgtactttaacgtccgttaccggtttaccgggaacccgttacggggaacctaacggggtccctacccggtttccgtttaggtacccg

SEQ ID NO: 330331 - DNA, 617 bp, Homo sapiens
  misc_feature: GZ8MTXP02FVPIK.2.76.G10.1.454.CMB.2.raw
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgtctggaggcacctccaacatcgggcgtgataatgtgtactggtacaagcaggtcccaggaaccgacccccaaaactccctcactcctctcaacaaataaactcaacgccggcccctcgacggtactcccctagacccgtattcctactcgccctaccaacggtcccggcaccctccacgcccctccctcggacccagtccaggttcgggcccgtcccgggggaccggagggacgtcgggacggtccttaggtaatttacgttacgtggtgacgagggtaatcgggggaatacgaacgtaaaccgttggggtactcgttacgtcgttcgttcggaaccgtcgggaacctacgggtccctaccggttccgttcggtaccg

SEQ ID NO: 330332 - DNA, 682 bp, Homo sapiens
  misc_feature: GZ8MTXP02JAG4L.2.76.G10.1.454.CMB.2.raw
  modified_base (218)..(218): a, c, t, g, unknown or other
  misc_feature (218)..(218): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccggnagaggtcaccatctcttgtctggagcacctcaacatcgggctgataatgtgtactggtacaagcaggtccccaaggaaccgacccccaaaactcctacaatcctctccaacaaataaatcaacgccggcccctacaacgggctccccctagacccgtatttcctcctcgacccttaccgaaacgtccccggacctaccctacaccgtccccttcccgtacggccctaacttcgaacggtcggggaccctcccgggggacccgaagggattcgggagggaccttagggtaaactttaagttaaccgttggtacgacgtagggacgtaggggtattacggaaaccgtaaacccggttgggggttataccgtttaaacttccgttaccgtttaccggggaacccgttacggggtaaaccccgaaaacggggtttcccaaacccggtttcccgtttacgggtaacccg

SEQ ID NO: 330333 - DNA, 523 bp, Homo sapiens
  misc_feature: GZ8MTXP02J1QGS.2.76.G10.1.454.CMB.2.raw
  modified_base (510)..(510): a, c, t, g, unknown or other
  misc_feature (510)..(510): n is a, c, g, or t
  modified_base (513)..(523): a, c, t, g, unknown or other
  misc_feature (513)..(523): n is a, c, g, or t
tcagacgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcgaggggtcccctgacccgattctctgccctcaagtctggcacgtcagccttctggacatccgtggcctccagtctgcggatggaggtcttgtttatttctgttctagcacggggatcgaccagccggaatgggactaagttgggggtattcggggacgggagggacctaaggttcgacccgtacgtaagtcacgcccaaggctcgccccctcggtccacgtctcgttccccacccttcctcgtcgtcgacgtcgtctcggaggcgggctggcaggcgacanagnnnnnnnnnnn

SEQ ID NO: 330334 - DNA, 608 bp, Homo sapiens
  misc_feature: GZ8MTXP02JE669.2.76.G10.1.454.CMB.2.raw
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (587)..(587): a, c, t, g, unknown or other
  misc_feature (587)..(587): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctcaacntcggctgatagtgtgtactgtacagcacggtcccaggaaccacccccaactcctacactctctacacaataactcacgccgccctcaggctcccngaccgnttcctctcgccctacgaacgtcccgctaccctcacgtcccctcccgtgaccctatccgagggtcgggcccgtccggggaccgagggtacgtcggaggtcttaggtaatttaacgttaccgtggtacgacgtaagggtagttagggggattacggaaccgtaaccggttggggtactacgtttactccgttacgtttccgggaaccgttcgggggaaccctacggggtaccncccggtttcgtacggtacccg

SEQ ID NO: 330335 - DNA, 615 bp, Homo sapiens
  misc_feature: GZ8MTXP02HFJUU.2.76.G10.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcagccaccctcagcgtcgtcgggtcccccgggnagagggtcaccatctcttgttctggcgcacctccaacngtcgggctgataatgtgtactggtacaagcacggtcccaggaaccgacccccaaatcctcactctctcaacgaataaactcacgccgcccctagacggacgtccctgccgtattccnctcgccctcaacgtcccggcacctcaccgccctccctcgccctancgtacggtcggggcctccggggccgaggagtggaggtcctaggatttaactcgtggtagacgaggtagtacggggatacggtaaccgtaacggttggggtactactttacgttcccgttcgttacccggggaaccgttacggggaacccgtaaacgggttcccgaccggtttccccgttaggtaacccccgg

SEQ ID NO: 330336 - DNA, 702 bp, Homo sapiens
  misc_feature: GZ8MTXP02JUTRJ.2.76.G10.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcgagggtcctgggcccagtctgtgctgactcacgcccaccctcagcgtcgtccgggtcccccggnaggacggtcacatctcttgtcnggngaaaacncctacangcgggntnatatgtagtactggacagcaacggtcccaacggaacccaacccccaaatcctactaactcctctaccaaactaaactaactcgaaccggcccggtaccctacgacggtaccgtccccgaggtacccgtcttcctccgtccgacccttacccgaaaccgggttccccggaaccctaccctcgacccgtccccgtcccggtacggaccctactaccgggtacggggtccgggcccggtaccccgggggaacgtagggacgttcgggaacgtccgtttaaggtaacctttaagtacggttcggagtacggaagggttaggtaggggaacttacggaaacccgtaccggggtttggacttaccgtttactccgttaccggtacggaaccgttacgggaaaaccgtcggtaccctaccgtttcggagtaacccg

SEQ ID NO: 330337 - DNA, 632 bp, Homo sapiens
  misc_feature: GZ8MTXP02HSYY1.2.76.G10.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcggggtcccccggnaggagggtcaccatctcttgttcnggagcacctccaacatcgggctgataatgtgtactggtacaagcaggtcccaggaaacccgacccccaaatcctacatctctacaacaataactcacgccggcccctgacggtactccccctgacccgtatttccgtctaccgtccctaccgaacgtcccggactacccgtctaccgccctcccgtcgggccctaacttcgacggttccggggccgttccccgggggccggaaggtacgttcggagggtcctaggtatttaacttaccgtggtagcgagggtagtggggtaatcggaaccgtaaccgttggggtctacttacgtcttcccgttacggaacccgttggggaacccttaagggcctaacccggttccgtttacggacccg

SEQ ID NO: 330338 - DNA, 655 bp, Homo sapiens
  misc_feature: GZ8MTXP02HPK1O.2.76.G10.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtactgggcccagtctgtgctgactcagccaccctcagcgtctcgggtcccccgggnagaggtcaccatctcttgttctggagcacctccaanatcgggcgtgataatgtgtactggtacaagcacggtccccaaggaacccgaacccccaaactcctacattcctctacaaacaaagtaaactccgaaccgccggaccctcgaacgggtacgtcccccgtgacccgtatttcctactcgcccttaccgaacgtccccggacaccctcgaccgtcccctcctcggccagttcgaacggtcgggccgtcccggggaccggaggtagtcgggtacgtcgtagtaatttacgttacgtggtacgacgaggtagtaggggacttacggaaacccgtaccggtggggttcgttacgtttacgtccgtttaccggttcgggtaacccgtacgggaacccgttaaacggtccgtaaccccggtttcgtttacggaaccg

SEQ ID NO: 330339 - DNA, 694 bp, Homo sapiens
  misc_feature: GZ8MTXP02F7RBA.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccggnaggacgggtcaccatctcttgttctggacgcacctcaacatcgggctgataatgtgtactggtacaagtcacggtacccaaggaacccgacccccaaaactcctacactcctctacaaactaataactcacgccgccctacgacggtaccgtcccgtaggaccgtatttccgtacgtccgtcccctaaccgtaacgggtcccggccctaccctccgaaccgtcccccttcccgttcgggaccctaacgtccgtaacggggttccggggcccgtcccgggggaacccggaagggagttcggggaacgtccgttaggtaacgtttacttacgttggtcgacggaggtagtggggaacttcggaaaccgttaaaccggttggggtacttaccgtttacgttccgttcggtttaccggaacccggttacgggtaacccgtaaacggtcccgtaaccggtttcccgttacgggtaacccg

SEQ ID NO: 330340 - DNA, 631 bp, Homo sapiens
  misc_feature: GZ8MTXP02GCYB3.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttctggagcacctcaacatcggcgtgataatgtgtactggtacagcaggtcccaggaaccgacccccaaactcctcatctctcacaataatcacgccgccctcaggacgtccctgaccgtattcctctcgccctaccgaaacgtcccggacctaaccctccgacgtcccctcccgtcggcccactccgacggttcggggcccttcccgggggaccgaagggactggaacggctaggtatttacgttacgtgttggcagggtagtggggaattcggaaccgtaaaccggttgggggttactaccgtttagttccgttccgtttccgggaacccgtttcgggggaaaccctaaacggggttccctaacccggtttccgtttacgggtaaccccg

SEQ ID NO: 330341 - DNA, 662 bp, Homo sapiens
  misc_feature: GZ8MTXP02H7TMK.2.76.G10.1.454.CMB.2.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnaggagggtcaccatctcttgtctggagcacctcacntcggctgatangtgtactggtacagcaggtccaggaacccaccccaaatcctacatctctacaaactaaataactcgacgccggtaccctacgacgggtacctcccgtagacccgtatttcctccgttcgaccccttaccgaaacgttcccgacccacccgtcacgtccccttcccgcggtacctaacgtccgtaaggtccggggcccgtacccgggggcccggtaagggtacgtacgggtaaggtccgttaggtaacgttttacgtaaccgtggtacgacgtaggtagtacggggacttacggaaccgtaaccggttggggtactccgtttaacgtccttcggttaccggtaacccggttgggaaacccgtacggtcccgtaacccggttcgtttacggacccg

SEQ ID NO: 330342 - DNA, 581 bp, Homo sapiens
  misc_feature: GZ8MTXP02FYGNW.2.76.G10.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctccaacngtcggcgtgataatgtgtactggtacaagcacggtcccaggaaccacccccaaaactcctacactctctacaacaataactcacgccgcctcacggctccctgaccgtnttacctctcgccctacgaaacgtcccggactaccctcacgtccctcccgtggcccatcgaggtcgggccgtccgggccgaggacgtggacggctaggtaatttacgttacgtgtgacgaggtagtgggatacgaacctacggttggggtctacttacgttcgtccgttaccggaacgtacgggaaccgaacggtcctaccggtccttaggtacccg

SEQ ID NO: 330343 - DNA, 600 bp, Homo sapiens
  misc_feature: GZ8MTXP02GNIIK.2.76.G10.1.454.CMB.2.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (253)..(253): a, c, t, g, unknown or other
  misc_feature (253)..(253): n is a, c, g, or t
  modified_base (370)..(370): a, c, t, g, unknown or other
  misc_feature (370)..(370): n is a, c, g, or t
tcagacgctcgacacacgaccggtgctcgatttagtcactcatacaggggggagagatctgggggaagctcagcttcagctgtggtagagaagacaggattcaggacagtctccagcatggccgcttcctctcctcctcaccctcctcactcactgtgcagggtcctgggcccagtctgtgctgactcagccaccctnagcgtctcgggtccccggnaggaggtcaccatctcttgtctggagcacctcaacngtcggctgataatgtgtactggtaacaagcacggtcccaaggaaccgacccccaaaatccctacactctactacaacaaataatcacgccggccctagacggacgtccctgaccgtnttctctcgcctacaagtcccgacacctcacgcctcccgtgaccagtacgacggtcgggccgtccggggaccgaggagttcggacgggtctaggtaactttaacttacgtggttcgacgaggtagtggggaattacggaaccgtaccgttaggggtcgtacctttacgttcgttccgttacgggaaccgtcgggaaaccgtaacggtccctaaccgtaccgtttcggaccg

SEQ ID NO: 330344 - DNA, 646 bp, Homo sapiens
  misc_feature: GZ8MTXP02H8YTU.2.76.G10.1.454.CMB.2.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (392)..(392): a, c, t, g, unknown or other
  misc_feature (392)..(392): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgcccacctcagcgtcgtcgggcccccggnaggacgggtcaccntctnttgtcnggacgcacctcaangtcgggctgatatgtgtactggtacagcgacggtcccaaggaaccccgaaccccaatcccacatcctactacaaactaataactcaacgccggtaccctgacgggtacctccccgtaggaccctactttccnccgtcgtaccccctcgaaacggtcccgaccctacctccgacgtcccccttcccggacgtaccctactcgtacggggttcgggcccgtaccgggggaccgaagggttcagggtcggcttaggtactttataccggtgtacgaggaagtgtagggaacttcggaaacctacggtgggtacttcttacgtccgttaccgttaccgggaaccgttacgggaaccgtacggttccgtacccgttcggtttaccgacccg

SEQ ID NO: 330345 - DNA, 575 bp, Homo sapiens
  misc_feature: GZ8MTXP02HAV8Z.2.76.G10.1.454.CMB.2.raw
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttctggaggcacctccaacatcgggctgataatgtgtactggtacaagcaggtcccaggaaccgacccccaaatcctcatcnctcacaataatcacgccgcctnaggctcccngccgattctctgcctcaagtcccgcaccctcacgccctacctgaccactcgaggtcgggctcccgggccggaggacgtggaacgggtctaggaatttaactcgtggtcacgaggagtggggactcggaaacctacggttggggtctctttaactccgttccgttcgggaacccgttgggggaaacccctaaggggttcccacccggtttctttacgggaaccc

SEQ ID NO: 330346 - DNA, 649 bp, Homo sapiens
  misc_feature: GZ8MTXP02F0WIQ.2.76.G10.1.454.CMB.2.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtccccggnagaggtcacatctcttgtctggagcacctcaacngtcgggctgatatgtatacgtgtaacagcacggtacccaacggaaccgacccccaaactccctacactctcctacaactaatactaccacggcccggccctcgacggtaccgtcccctagacccgtactttccgtctccgaccctaccgaacggtcccggcctaaccctccgacgcccctccgtcgcccactacgacgggtcggggcccgtaccgggggaccgagggtacgtacgggacggttaccgtaggttaactttaacgttcgtcggtacggtacgaggtgtacgggatacgtaaacgtccggttggtaacgttcttacgttcctaccggtttacggaacccggtacgggtaaccgtaaccggtctacccggtttccgtcgggtaacccg

SEQ ID NO: 330347 - DNA, 551 bp, Homo sapiens
  misc_feature: GZ8MTXP02FZ4O3.2.76.G10.1.454.CMB.2.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctccaacngtcgggcgtgataatgtgtactggtacagcaggtcccaggaaccgacccccaaatcctcatctctacacaataatcacgccgcctnaggactccctgcctatctctcgcctacacgtccgcacctcacgccctcctgccatcgagtcgggcgtccgggcgaggactggacgctagtatttagtactggtgcgaggagtggggatacgacgtaacggttgggtactacgttactccgtcgttaccggaaccgttacgggaccgtaaacggtccgtaccggttccgtttcggaacccg

SEQ ID NO: 330348 - DNA, 582 bp, Homo sapiens
  misc_feature: GZ8MTXP02IPNNN.2.76.G10.1.454.CMB.2.raw
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (313)..(313): a, c, t, g, unknown or other
  misc_feature (313)..(313): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctgggtccccggnaggaggtcacatctcttgtctggagcacctcaacntcgggctgataatgtgtactggtacaagcaggtcccaggaaccacccccaatcctcatctcncacaataatcagccgcctcgaggactccctgacccgtattcctctcgccctacaacgtcccggcacctcacgccctcccgtgccatcgaggtcggggcctcccggggaccgaggtacgtcggacggtccttaggtacttacttacgtgtgacgaggtagtggggactcggaaccgtaaccggtggggttactactttacgtccgttcgttacgggaaccgttacgggaacccgtacggttacccgtacccggtttcgttacgggtaccg

SEQ ID NO: 330349 - DNA, 591 bp, Homo sapiens
  misc_feature: GZ8MTXP02IBLZE.2.76.G10.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (254)..(255): a, c, t, g, unknown or other
  misc_feature (254)..(255): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (464)..(464): a, c, t, g, unknown or other
  misc_feature (464)..(464): n is a, c, g, or t
  modified_base (495)..(495): a, c, t, g, unknown or other
  misc_feature (495)..(495): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcgggtccccggnaggaggtcacatctnttgtctggacgcacctcacnncgggctgatatgtgtactggtacagcaggtcccaggaacccaacccccaatccncatcctctacaactaaatatcacgcccggacctacgacgggtactcccgtagaccgtatttccncgtccgtccctaccgaacgtcccgcccaacctcaccgtccctcccgtgaccctacgtcgtacgggtcgggccgtccggggaccggaggtancgggagtctaggatttagtcgtgtgacgagnggtacggatacgacgtaccggtgggtctacttcgcgtttaccggtacggtaaccgtcggaacctacgggtcccttacccggttcgttacgacccgg

SEQ ID NO: 330350 - DNA, 660 bp, Homo sapiens
  misc_feature: GZ8MTXP02IGNVM.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagtccaccctcagcgtctcgggtcccccgggnaggagggtcaccatctcttgttctggaggcacctccaacatcgggcgtgataatgtagtactggtacaagcaggtcccagaccgacccccaaatcctcatcctctacacaataatcacgccggccctcgaggtacgtcccctgacccgtattacctcctcgccctaccaaacgtcccggaccaccctcacgccctacccgtcgcccagtccaacgggttcgggcccgttcccggggacccggtacgggtagtacgggacggccgttaggtaacgtttagtttaaaccgtggttacggcccgtaaagggtacgtagggggtactacggtaaccgtaaacccggttgggtcgtactttaacgtccgttaccgttacccgggtaaccgtacgggtaacccgtaacggtcccgtaacccggttccggtttacggtaaccccgg

SEQ ID NO: 330351 - DNA, 554 bp, Homo sapiens
  misc_feature: GZ8MTXP02JDYVW.2.76.G10.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (255)..(256): a, c, t, g, unknown or other
  misc_feature (255)..(256): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnaggaggtcacntctcttgtctggagcacctcaacnncgggctgataatgtgtactggtacaagcaggtcccaggaaccgacccccaaatcctacatctctacacaataatcagccgcctnagctccngccgtatcnctcncctacagtccgacactcacgccctacctgaccncgtcaggtcgggcgtccggggacgtacggntaggacgcgtagtacgttacttacgtgtcggcaggtagtagggatacggaactaaccgtggggtactacgttatccgttacgtaccgtaacggtacggacctacggtacccgaccgttccgtttagacccg

SEQ ID NO: 330352 - DNA, 603 bp, Homo sapiens
  misc_feature: GZ8MTXP02FL0JL.2.76.G10.1.454.CMB.2.raw
  modified_base (319)..(319): a, c, t, g, unknown or other
  misc_feature (319)..(319): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctggggtcccccgggcaggagggtcaccatctcttgttctggaggcacctccaacatcgggcgtgataatgtgtactggtacaagcaggtcccaggaaccgacccccaaactccncatctctcaacaatactcacgccggcccctcaggacgtccccctgacccgtattcctctcgtccctaccaaacgtcccggccacctccacgccctcccctggcccatcgacggtcggggccgtcccgggggccgagggtattacggagggcttaggtactttacgttaacgtggttcggcgaagggagtacggggatacgaaccaacccgttgggtctcgttactcctcgttacggaacccgtggggtaacccaacgggtccacccgttccgttacggtacccg

SEQ ID NO: 330353 - DNA, 595 bp, Homo sapiens
  misc_feature: GZ8MTXP02HL2TK.2.76.G10.1.454.CMB.2.raw
  modified_base (220)..(220): a, c, t, g, unknown or other
  misc_feature (220)..(220): n is a, c, g, or t
  modified_base (346)..(346): a, c, t, g, unknown or other
  misc_feature (346)..(346): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtccccggnaggaggtcaccatctcttgttctggagcacctccaacagtcgggctgataatgtgtactgtacaagcacggtccccaaggaacccgaacccccaaactccctacacttcctactacaaacaatacncacgccgccctagacggtacgtccctacgaccgtctttactctcgccctacgacgtcccgacacctccacgtcccctccgtcgacctactgacgggtcgggcccgtccggggacgacggtatggacggctaggtacttatacgtgtcgcgtaggngtaggntacgaccgtacggtgggtactacgttagtccgttaccgtcggaaccggtacggaaccgtacggtcctacccggtcgtttacggacccg

SEQ ID NO: 330354 - DNA, 568 bp, Homo sapiens
  misc_feature: GZ8MTXP02J1GMH.2.76.G10.1.454.CMB.2.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcaggagggtcaccatctcttgttctggagcacctccaacatcgggcgtgataatgtgtactggtacaagcaggtccccaggaaccgacccccaaatccncatctctcacaatancagccgcctnaggctcctgccgnttcnctgcctcaagtccgcacctcacgcctccngccactcaggtcggcgtccgggcgagntcgaggctaggatttatacgtgtgacgaggtagtaggggattacggaaccgtaaccggtgggggttactactttacgtccttcccgtttaccgggaaccgttccggggaaccgtaacggggtccctacccggttccccgtttggtaccccg

SEQ ID NO: 330355 - DNA, 632 bp, Homo sapiens
  misc_feature: GZ8MTXP02IRRI5.2.76.G10.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (369)..(369): a, c, t, g, unknown or other
  misc_feature (369)..(369): n is a, c, g, or t
  modified_base (512)..(512): a, c, t, g, unknown or other
  misc_feature (512)..(512): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggagaggtcacatctnttgtctggagcacctcaacntcgggctgatatgtagtactggtacagcaggtcccaaggaacccgaccccaaactctcactctcacacaataactcacgcccgcctacgacggtactccctagacccgtatttccnccttccgccctccgaaacggtccccggacctaccctacgacccgtcccctcccgttcggaccctacgtacgtacggggtcgggcccgttcccggggaaccgaaggggttacgcgggacgtacttagtaacgtttaacgttcgnggttcgaggtaggtaaggtacgggacgtaacgaccgtacggttcggttacttacgtttacgtccgttacggtaccggaacgtacgggaacgtaccgtccgtaccggtttcgtacgtaccg

SEQ ID NO: 330356 - DNA, 675 bp, Homo sapiens
  misc_feature: GZ8MTXP02HQMUE.2.76.G10.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccgggnagacgggtcaccatctcttgttctggagcacctccaacngtcgggcgtgataatgtgtactggtacaagcgacggtcccaaggaacccgaacccccaaactccctcactctctacaacaaataactcacgccggccctacgacggtagtccccctaggacccgtatttcctcgtccgtaccctacccgaacggttccccggccacccttccgacccgtcccctccccgtggccctacttcgtcgggttccgggggcccgtacccgggggcccggaaagggtcgtacgggtacgggtacctagggttaatttacgttaccgttgggtcgacgtaaggagttgggggaacttcggaacccgtacggttggggtctacgtttacgtcgttaaccggttccggtaacccggtggggaaaccccgttagggtccctaccgttccggtttaggtacccg

SEQ ID NO: 330357 - DNA, 660 bp, Homo sapiens
  misc_feature: GZ8MTXP02HV8DM.2.76.G10.1.454.CMB.2.raw
  modified_base (219)..(219): a, c, t, g, unknown or other
  misc_feature (219)..(219): n is a, c, g, or t
  modified_base (505)..(505): a, c, t, g, unknown or other
  misc_feature (505)..(505): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcgggtccccggnaggacgggtcacctatctcttgttctggacgcacctcaacagtcgggctgataatgtgtactgtaacagcacggtcccaaggaacccgaacccccaaatccctactactcctactacaactaaactaactcacgcccgtccctacgaacggtctaccccgtgaccgttattcctcgtaccgtacccttacccgaaacgttcccggaccctaaccctacgacccgtccccctcccgacgggtacctaccgttacggacggggttccgggccggtcccggggaaacgngggtaaactcgggaacgggttcttagtaatttacgttacgtggtacgacgaggtagtggaactcgaaacgtacggttgggacttacttacgtcccttcgggtaccgtaaccggtacggtaaaccgtacggtccgtaccggttctttacggacccg

SEQ ID NO: 330358 - DNA, 664 bp, Homo sapiens
  misc_feature: GZ8MTXP02IBMIC.2.76.G10.1.454.CMB.2.raw
  modified_base (221)..(221): a, c, t, g, unknown or other
  misc_feature (221)..(221): n is a, c, g, or t
  modified_base (256)..(257): a, c, t, g, unknown or other
  misc_feature (256)..(257): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnagagggtcaccatctcttgtctggagcacctcaanncgggctgataatgtgtactggtacagcacggtcccaaggaacccgacccccaaatccctacacttcctctacaaactaaataacgtcacggcccggcccctacgacgggtaccgttcccctggacccgtactttcctcctcgtccccttaccgaaacgttccccggacctaccctcgacgtccccttcccgcggaccctagttccgagggttccgggcccgtcccgggggaccggagggtacgtacgggacgggtcttaggtactttagttacgtggtcgacgtagggagttaggggacttacggaccgttaaacggttgggtaccgttacgtttacgtccgtttccgtacgggaaccgtacgggaacccgtaacggttccgtacccggtttcgttaccggaacccg

SEQ ID NO: 330359 - DNA, 627 bp, Homo sapiens
  misc_feature: GZ8MTXP02JLC19.2.76.G10.1.454.CMB.2.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctcgggtcccccgggnaggagggtcaccatctcttgttctggagcacctcaacngtcggcgtgataatgtgtactggtacagcaggtcccaggaaccacccccaaatcctcactctctacacaatactcacgccggcccctagacggtactccctgaccgtactttctcctcgaccctaccgaaacgttccccggaccacccttccaccgtccctcccgtcggaccctacgtcgacggtccgggaccgtcccgggggaccgagggacgtggacggtcttaggaatttacgttacgtgggtcgacggtagggagtggggactacggaaccgtaaccggttggggtctacctttaactcgtttcccggttacggaaccgttacgggaacccgtacgggtccctaccggttcgttacggtaacccg

SEQ ID NO: 330360 - DNA, 596 bp, Homo sapiens
  misc_feature: GZ8MTXP02J07I4.2.76.G10.1.454.CMB.2.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (520)..(520): a, c, t, g, unknown or other
  misc_feature (520)..(520): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggnagagggtcaccntctcttgttctggagcacctccaacatcgggctgataatgtgactggtacagcaggtcccaggaccgaccccaaacctctcatctcncacaataatcagccggccctcaggacgcccttgaccgtnttctctgcctcccaagtcccggcaccctnaccgccctccctggcccactccaggtcggccgtcccggggccggtaaggactcgggaggtcttgggatttactttaccgtgtacggtcaggggtaactggggaaaccttgaaaccgtaaacccgtcgggggttnccgtttacgtccgtacgttccggtaaccgtcgggggtaaccgaaacggtttccgaacgttccccgtttaggtcccg

SEQ ID NO: 330361 - DNA, 728 bp, Homo sapiens
  misc_feature: GZ8MTXP02JDR8E.2.76.G10.1.454.CMB.2.raw
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcacgcgttccgtcggggtcccccggnaggagggtccacatcttcttgtcgtggngccacctccaacngcgggntgatatgtgtacgtggtaacagcgacggtccccgaacggaacccgaaccccctaaactcctactacttcctactaccaataaactaactccgaaccgtccccggaccctacgaacggtaccgtaccccgtacgacccgttactttcccgtcgtccctacccgtacccgtaaccgggtcccccgaccctacccgtaccgtacccggtcccccttccccggtcggaccccctaggttacccgtacggggtccggggtacccggtccccggggtaacccggaagggttacgtacgggtaccggggtactttacgggttaaacttttacgttaccggtgggtacgtacgggtaagggtacgtaggggacttaacggaaaaccgttacgggtcggtacgttcttacgtccgttacgttaccggaacgttacggactacggtacctccgttcgtcgaccg

SEQ ID NO: 330362 - DNA, 701 bp, Homo sapiens
  misc_feature: GZ8MTXP02HGDG9.2.76.G10.1.454.CMB.2.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (391)..(391): a, c, t, g, unknown or other
  misc_feature (391)..(391): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccggnagagggtcaccatctcttgttcgnggacggcaccctccaacagtcgggcgtagataagtgtgttactggtaacaagcacggtacccaaggaacccgacccccaaatccctacactctcacaactaaataactcacgccggcccctgacggacgtcccagcccgtattcnccgtcgccctccaacggtcccgcctaccctcaccgtccctccgtcgcctacgcgtacggttcgggcccgtccgggggaccgagggtaactcgggacggtcgtttaggtaacttttaacgttaccggtaggttcggacgaaggggtacggttaggggaacgttacggaaccgttaaacccggggttggggttcgttaccgtttaaacgtttcccgtttaacccggttaccggtaaccccgggtttacgggggaaaccgttaaacccggggttaccctaaccccgggtttccgttttacgggggtaaccccg

SEQ ID NO: 330363 - DNA, 608 bp, Homo sapiens
  misc_feature: GZ8MTXP02JPW9Z.2.76.G10.1.454.CMB.2.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (432)..(432): a, c, t, g, unknown or other
  misc_feature (432)..(432): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggacgggtcaccatctcttgttcnggacgcacctccaangtcgggctgataatgtagtactggtacaagcaggtcccaaggaaccgacccccaaaactcctacacttcctctacaaactaataaactcaacggccggccctacgacggacgtccccctagacccgtattctctcgccctacgaacgtcccggacacctcacgccctcccncgcctacgtcgagtcgggccgtcccgggacgacggatggacgtcgtaggtattacgttacgtgtcgacgtaggagtagggatacggaccgtaacggtggggtactacgtttacgtcgttacgttccggaaccgttcggggaaccgtaacggtccacccggtttcgttcggtacccg

SEQ ID NO: 330364 - DNA, 649 bp, Homo sapiens
  misc_feature: GZ8MTXP02JUYJY.2.76.G10.1.454.CMB.2.raw
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcctcggggtcccccgggcaggagggtccaccatctcttgttctggaggcacctccaacagtcgggcgtgataatgtgtactggtaacaagcacggtaccccaaggaaacccaaccccccaaactccctacatcctctacaaactaaataaactcaacgcccggtacccctacgaacgggtacgtaccccctaggacccgtatttcctcctcgccctaccaaacggtcccggaccaccctcaacgtccccctcccgtggaccctacgtcgacgggtcgggacccgtcccgggggaccgagggactgggagtcctagtaatttactacgtggtgacgagggtagtggggaactcggaaaccaaccggttggggtactacgtttactccgttcgttaccggaaccgtacgggaacctaacggtcctacccgttccgttaggacccg

SEQ ID NO: 330365 - DNA, 713 bp, Homo sapiens
  misc_feature: GZ8MTXP02IUP5T.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtccggggtccccggnaggacggtcaccatcttcttgttcgtggacggcaccctaccaacagtcgggacgtagataagtgtagtacgtaggtaacagcgacggtacccgaacggaacccaacccccaaactccactactctctacaactaaataactcgaccgcccggcctcgacggaccgtccctagaccgtacttcactcgtccctaccgaacgtcccgaccacccgtccaccgtcccctcccgtcggcctaacgtccggaacgggtccggggcccgtacccgggggaccggtaaagggtcgtacggaacggtcttagttaaacgtttacgttacgtgggtacgacggtaaggggtagtacggggtaactacggtaaacccggtacggttagggttaccggtactttttaaccgtccgtttacccgggttaccgggaacccggttaggggaaaccccgttaacgggtccccttaacccggtttcccggttacggtaacccccgg

SEQ ID NO: 330366 - DNA, 714 bp, Homo sapiens
  misc_feature: GZ8MTXP02H2FDB.2.76.G10.1.454.CMB.2.raw
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcacggccgtcgtccggggtccccccgggcgaggacgggtccacctattcttcgtttgttcgtgggacggccaccctaccaacacgtcgggctagataatgtgtactggtaacagcacggtacccaggaaaccccgacccccaactcctacactctaccacaactaaatactccgacgtcccgtccctacgaacggtacctcccgtacgacccgtacttcctccgtccgccccttaccgaaccggtcccgaccctaccctccgacctccccgtacccgtcgaccctcgtaccgtacggggcccgggtcccggtacccgggggaccggtaaacgggtacgtacggggtacggtaccgttaggttaacgttttacgttaacgtcggggtacgacggtaagggtacgggtaggacgttaacggaaccgttacggggtcggtacgttacttcgtaccgttacgttacggaaccgttacggaaccgtacggttaccgacccggtttcgtacggtacccg

SEQ ID NO: 330367 - DNA, 599 bp, Homo sapiens
  misc_feature: GZ8MTXP02JXDOM.2.76.G10.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctccaccctcctcactcactgtgcagggtcctgggcccagtctgtgctgactcagccaccctcagcgtcgtcgggtcccccgggnagaggtcacatctcttttcnggagcacctccaacngtcgggctgataatgtgtactggtacaagcaggtcccaggaaccgacccccaaatcctacatcctctacaactaaagtaactcaggccccggccctacgacggtacgttcccncggaccgtntttcctcttcgccctaccaacggttcccggccaccctcacgccccttcccagcccatccgaggtcgggcctccccggggacgtaggactggacggtcctagatttagtacctggtcgcgtaggagttggggaatggaaaccgtacgtgggtacgactttacgtccgtccgttacggacccgtgggacccctaaggtccaccggttccttgggaccaacgg

SEQ ID NO: 330368 - DNA, 603 bp, Homo sapiens
  misc_feature: GZ8MTXP02FREB6.2.76.G10.1.454.CMB.2.raw
  modified_base (354)..(354): a, c, t, g, unknown or other
  misc_feature (354)..(354): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggaggcacctccaacatcgggctgataatgtgtactggtaacaagcaggtcccaaggaacccgacccccaaaactcctacactctctcaacaataactcacgccgccctanacggactcccagaccgattcctctcgccctacaacgtcccgacaccctcacgtcccctccgtcgcccacgttcaggtcgggcccgtccggggaccgaggatggacggcttagtaatttacgttacgtggtcgacgtaggagtgggaactcggaacctaacggttgggtactacttttacgtccgttccgttaccggaaccgttacgggaaccgtaacggtcctaacccggtttccgtacgggtaacccg

SEQ ID NO: 330369 - DNA, 673 bp, Homo sapiens
  misc_feature: GZ8MTXP02IMPB0.2.76.G10.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagacgctcgacacacgaccggtgctcgatttagtcactcatacaggggggagagatctgggggaagctcagcttcagctgtggtagagaagacaggattcaggacagtctccagcatggcccggcttccctctcctcctcaccctcctcactcactgtgcagggtcctgggcccagtctgtgctgactcagccaccctcagcgtcgtcgggtcccccggnaggagggtcaccatctcttgtctggaggcacctccaacngtcgggcgtgataagtgtagtactggtacaaggcacgggtaccccaaggaacccgaaccccccaaaattcccctcaacttcctcctacaactaataaactcaacggcccggccctacgacgggtacgtccccctgacccgtattcctcgttcgacccttaccgaacgtcccggaccctaaccctcccgtaaccgccccgttcccgtccgggaccctacgtacgtacggggttcgggacccggttcccggggaccggacgggattacgggacgtccgtaggttaactttaacgttacgtggtgacgagggtagtcggggaatcggaaccgtacgtcgggttactcgtttactccgttcgttaccggccgtacgggtaccgtaacggtccgacccggtttccgtacggtaaccg

SEQ ID NO: 330370 - DNA, 619 bp, Homo sapiens
  misc_feature: GZ8MTXP02J0TJ4.2.76.G10.1.454.CMB.2.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
  modified_base (535)..(535): a, c, t, g, unknown or other
  misc_feature (535)..(535): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctgggtcccccggnaggagggtccaccatctcttgtctggagcacctccaangtcgggctgataatgtgtactggtacaagcaggtccccaggaacccgacccccaaaactcctacatctctacacaaataatcgaacgccggaccctgaggtactcccngacccgnttacctctgcccttaccgaaacgggttccccgacctacccgtacaccgtccccttccccgnggaccccaagttcccgaagggtcggggaccctcccgggggacccgagggtaactggaacgggtccttaggtaactttaagttaccgttggacgacgagggtancggggactacggaacctaacgtggggtatcgttagtcgttacgttcggaaccgtcggaacccaaggtcctaccgtcttcggtac

SEQ ID NO: 330371 - DNA, 654 bp, Homo sapiens
  misc_feature: GZ8MTXP02FSDDV.2.76.G10.1.454.CMB.2.raw
  modified_base (219)..(219): a, c, t, g, unknown or other
  misc_feature (219)..(219): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccggnagagggtcacatctcttgtctggagcacctcaacagtcgggctgataatgtgtactggtacagcaggtcccaggaaccgacccccaaatcctcactcctctcaacaataactcgaacgccggcccctagacggtactcccctagcccgtattcctcgtccgccctacgaacggtcccgacctacctccgacgtcccctccgtcggacctacgtcgtacgggttcgggccgttacccgggggaccgtaaggacgtacggacgggtccttagggtaactttaacgttacgtggtacggtacgaggtaggtgggggtaactacggtaacctaaccgggttgggtacgtacctttaacgtcccgttacggttaaccggaaccgttaacggggaaccctaacggggttccctaacccgggtttccgtttacggtaacccg

SEQ ID NO: 330372 - DNA, 606 bp, Homo sapiens
  misc_feature: GZ8MTXP02JE0QN.2.76.G10.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (357)..(357): a, c, t, g, unknown or other
  misc_feature (357)..(357): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcacccctcctcactcactgtgcagggtcctgggcccagtctgtgctgactcagcccaccctnagccgtcgtcgggtcccccgggnaggagggtccacatctcttgttcnggagcacctccaangtcggcgtgataatgtgtacgtggtaacaagcacggtcccgaaggaaccgaccccctaaactcctcactctctacacaatactcacgccgcctnacggctcccgtgccgtattcctctcgcctaccgaacgtcccgcacctcacgtccctcccgtgcctacgtcgacggtcgggccgtccggggacgaggacgtggacgggtctaggtactttagtcgtggcgtacgaggtaacgtggggacttacggaacccgtacggtaggggtctacgtttacgtccgttccgttacggaacccgttcgggaaccgtacggttaacctcccggtttcgttacggtacccg

SEQ ID NO: 330373 - DNA, 735 bp, Homo sapiens
  misc_feature: GZ8MTXP02JOTO9.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccgggnaggagggtccaccatctcttgttcgtggacggcacctccaacacgtcgggcgtgataagtgtgtactggtaacaaggcacgggtaccccaaggaacccgaacccccaaactcctacactcctctacaactaaataacgtccaacggcccggtcccctacgaacgggtaccgttacccccgtaggtacccgtaacttttccgtacccgttccgtcccccgttaccccgaaacggttccccgggaccctacccgttaccgacccgtcccccttcccgtccgggaccctgtaacccgtcgggtccggggtcccgtcccgggggacccggaagggtactcggggcgtacgtacgttaagttacgtttacgtacggttggacgtaggggtagttaggggaatttacgggaacccgtaaccggttcgggggttactccgtttaacgtcccgtttcgtacgggtaacccgtacgggtaacccgtaaagtcccggtaccgtttacccggtttcggtacccg

SEQ ID NO: 330374 - DNA, 657 bp, Homo sapiens
  misc_feature: GZ8MTXP02G7V9Z.2.76.G10.1.454.CMB.2.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (330)..(330): a, c, t, g, unknown or other
  misc_feature (330)..(330): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnagacgggtcacatctcttgttctggacgcacctcaacntcgggctgataatgtacgtactggtaacaagcgacgggtccccaaggaaccccaacccccaaactcctanactctctacaactaaatatcacgccggtccctacgaacggtaccgttccccaggtacccgtatttccgtcctccgcccttaccaacgggtccccgacacccttcaccgtcccctcccgcgcctacgtccgtacgggtcggggtacccgtcccgggggaccggaagggtagtacggggacgttcctagggttaatttaacgttccgtgtccgacggtagggtagtgggaacttacggaaaccctagggttcggggtacttactttcgaccgtttcgtaccggtaaccgtaccggaaccgtacggtcctacccggtcgttacggacccg

SEQ ID NO: 330375 - DNA, 652 bp, Homo sapiens
  misc_feature: GZ8MTXP02I736R.2.76.G10.1.454.CMB.2.raw
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgtctggagcacctcaacagtcgggctgataatgtgtactggtaacagcacggtcccaaggaacccgaccccaaactcctacactctctacacaaatatcacgccgccctgacggactcccngccgtattcctcnccgtccctacaacggtcccgaccacctcgactccctcccgtcggaccactcgtacggtcgggcccggtcccggggaccggtaggacgttacgggacggtaccgttgggttaactttaacgtttaaccggttggttacggaaccggtaagggtaaggtaggggtaacgtttacggaaccgttaaaccggtggggttacgtacgtttacgtaccgttcggttaccgggtaaccgtacgggtaacccgtaacggtcccgtaccggttccggtttacgtacccgg

SEQ ID NO: 330376 - DNA, 597 bp, Homo sapiens
  misc_feature: GZ8MTXP02FWGCM.2.76.G10.1.454.CMB.2.raw
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagacgctcgacacacgaccggtgctcgatttagtcactcatacagggggagagatctggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggcagagggtcaccatctcttgtcnggnggcacctccaacatcgggcgtgataatgtgtactggtacaagcagtacccgagaaccgacccccaactctcatctctacacaatatcacgccgcctcgaggctacccctgaccgacttcttcnccgcctaccgaaacgtccgacctaccnccgtacncccgtcccgtgaccctactcgacggtcgggacccgtcccggggaccggacggagttcggaacgggtcttacggtaaatttacgttacgtgtcggacgaggtaagtggactacgaccgtaaacgtgggtcgacttttacgtcgttacgttcggaaccgttcgggaaacctacggtcctaccgttccgttagaacccg

SEQ ID NO: 330377 - DNA, 650 bp, Homo sapiens
  misc_feature: GZ8MTXP02HJZDB.2.76.G10.1.454.CMB.2.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagccgtcgtcgggtcccccggnaggacggtcacatctnttgtctggacgcacctcaangtcgggctgatatgtagtactggtacagcacggtaccccaacggaaaccccgaacccccaaactcctactactcctactacaaactaatactcgaaccggcccgaccctacgacggtacgtccccgtacgacccgtacttcctccgtccgacccttaccgaacggttcccccaaactaccccgtacgacccggtccccttcccggtcggaccctcgtaccgacgggtcggggacccgtcccggggacggtaggtagtcgggaagtccgttagttaacttacgttacggtgtcggtacgaagggttagtaggggacttacggacgttaccggtggtacttctacgtcgttacgcgccggtagaccctaggttcccaccgtttcgtacgaccg

SEQ ID NO: 330378 - DNA, 597 bp, Homo sapiens
  misc_feature: GZ8MTXP02FFV8X.2.76.G10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (535)..(535): a, c, t, g, unknown or other
  misc_feature (535)..(535): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggnagagggtcaccatctcttgttcnggaggcacctcaacatcgggcgtgataatgtgtactggtaacagcaggtccccaaggaaccgacccccaaaactcctacatcctctcacaaataactcaacggccgcccctagacggtacgtcccttgacccgattcctctcgcccttaccgaaacgtcccggaccaccctcacgccctcccgtgcccatccaggtcgggccgtccggggccgaggatggaggccttaggaatttacttacgtgtcgcaggagtggggaatcggaacctaaccgtggggtactcgtttacnccttccgttaccggaaccgtggggaaaccctacgggtacccaccggttccttcgggtacccg

SEQ ID NO: 330379 - DNA, 672 bp, Homo sapiens
  misc_feature: GZ8MTXP02FHNV4.2.76.G10.1.454.CMB.2.raw
  modified_base (220)..(220): a, c, t, g, unknown or other
  misc_feature (220)..(220): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccgggnagagggtcaccatctcttgttctggagcacctcaacatcgggcgtgataatgtgtactggtacaagcacggtcccaggaaccgacccccaaactccacactctctcaacaataatcacgccgcccctnaggactccctagacccgtattcctntcgccctaccaaacgtcccggacaccctacgacgcccctacccgtcggccctaacgtcgaacggttcggggacccgttcccgggggacccggaacggaggttcggaacgggtcttagggtaacttttaacgttacgttcggttaggaccgaaggggtacgttaggggacgttacggaaaccgtaaaccgggttgggggtacgttacctttaacgttccgtaccggtttaccgggaacccgtttacgggggaacccgtaaacggggttccctaacccggttcccggtttacggtaacccg

SEQ ID NO: 330380 - DNA, 627 bp, Homo sapiens
  misc_feature: GZ8MTXP02IZOQ2.2.76.G10.1.454.CMB.2.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (381)..(381): a, c, t, g, unknown or other
  misc_feature (381)..(381): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtcgtcgggtcccccggnaggagggtccaccatctcttgtctggngcacctcaacagtcggcgtgataatgtagtactggtaacaagcacggtcccaaggaaacccgacccccaaatccctcacttctactacaacaataactcacgccgtccctagacggtacgtcccctgaccgtntttcctcgtcgcccttacgaacgggttcccgacctaccctccaccgtccctacccgtcgacctacgtcgacgggttcggggcccgtacccggggaccggaggtacgtgggacgtcgttagtactttacgttcgtgtcgacgagggtagtagggtactcggaaaccgtaccggttggggtacttacgtttacgttccgttccgttacggcgtacggtacgtacggtcctaccgttcgtcggtacccg

SEQ ID NO: 330381 - DNA, 616 bp, Homo sapiens
  misc_feature: GZ8MTXP02JMQAE.2.76.G10.1.454.CMB.2.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcagggtactgggcccagtctgtgctgactcacgcccacctcagcgtcgtcgggtccccggnaggnggtcacatctcttgtcgtggacgcacctcaacngtcgggctagataatggtagtacgtggtaacagccgacggtaccccaacgggaaaccccgaaccccctaaacttccctactactcctctacaaactaatactcaccgccgccctagacggctccacgtccgtattcctctccgcctacgacgtcccgactcctccgactccctcgcgctacgtcgacgggtccgggaccgtcccgggacggaggtagtcgggacgtcgttagtaactttagtacgtggcgagtaggtacggtggacttacggacgttacggtgggtacttcgttactccggttacgtcggaaccggtacggtaaccgtacgtcccgtaccgtttccggtacgacccg

SEQ ID NO: 330382 - DNA, 599 bp, Homo sapiens
  misc_feature: GZ8MTXP02IY8VZ.2.76.G10.1.454.CMB.2.raw
  modified_base (222)..(222): a, c, t, g, unknown or other
  misc_feature (222)..(222): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcgggtcccccggnaggagggtccaccatctcttgttctggacgcaccctcaacagtcgggcgtgataatgtgtactggtacagcaggtcccaggaacccgacccccaatcctacatcctctacaacaataactcacgccgccctcgacggtactccccgtagaccgtacttcctcgtccgtcccttacgaacggtcccggaccaccctccacgtcccctcccgtcgacctacgtcgacggtcgggccgtcccggggacgaggtagtacgggtacgcgttagtactttacgttacgtgtcgacgaggagtgggatcgactacgtgggtctcttacgtccgtcgttacggaacgttacgggaacctacggtcctaccggttcgtacggtacc

SEQ ID NO: 330383 - DNA, 772 bp, Homo sapiens
  misc_feature: GZ8MTXP02FQSXM.2.76.G10.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcagggtcctgggcccagtctgtgctgactcacgcccaccctnagccgtccgtccggggtcccccgggnaggacgggtccacctattccttcttggttcgtgggacgccaccctcaacngtcgggctgataagtgtagtacgtgtaacagcgacgggtacccgaaacgggaaacccccaacccccctaaaactccctactaacttcctaccttaaccaaactaaactaaactccgaaccggtcccccgtacccctaggaaccggtacccgttacccccgtagggtaccccgttactttccctccgttacccgaccccttaaccggaaccgggtcccgacctacccgtcctaccgtcccccttcccggcgtacccacgttacgcggggttcgcccggtccgggggacgaaagggtcgtacggggacgttcgttaagttacgtttaccgttacggtaggtccgtaggaaggtagggtacggggaacttaaccgggaaccgttaaccgggttcgggggttactttacgtttacgtttccgtaccggtttacccgggaaccggttacgggaaacccgttaacggttcccgtaccggttccggtttacggaaccccg

SEQ ID NO: 330384 - DNA, 602 bp, Homo sapiens
  misc_feature: GZ8MTXP02F4Z8U.2.76.G10.1.454.CMB.2.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (551)..(551): a, c, t, g, unknown or other
  misc_feature (551)..(551): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgccaccctcagcgtcgtccggggtccccggnaggnggtccacatctcttgtctggagcacctccaacagtcggcgtagataagtgtgtacgtggaacaagcacggtacccaacggaacccaaccccaactccacactctctacacaaataatacgacgcccgccctacgacggtacctcccgagtccgtatttccgtactcctcctaccgacgtcccgacctacctcgacctccctccgtcgacctacgtcgagggtccggccgtcccgggacggacggtagtcggtacgcttaggtaactttacgttagtcggtagtacggaggtaggttcggaagtacgtaacgtacgtcggggtntacttacgtccgtcgttcggaacgtcggacgtacgctacgtcgtcgtaccg

SEQ ID NO: 330385 - DNA, 653 bp, Homo sapiens
  misc_feature: GZ8MTXP02HL91O.2.76.G10.1.454.CMB.2.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
tcagacgctcgacacacgaccggtgctcgatttagtcactcatacaggggggagagatcgtgggggaagctcagcttcagctgtggtagagaagacaggattcaggacagtctccagcatggccggcttccctctcctcctcaccctcctcactcactgtgcgagggtcctgggcccagtctgtgctgactcacgcccacctcagcgtcgtcgggtccccggnagacggtcacntctcttgtcnggacgcacctcaacngtcgggctgatatgtagtactggaacagcgacggtaccaaggaacccaaccccaatccanactctacncaaactaataacncacgccgtcctagacggtctccncgacctnttctcncnccctacacggtccgacctacctcgaccgtcccctccgtcgacctagtccgtaacgggtcccggggtacccgcccgggggaacggaggtacgtcggggtaacgtccgttaggttaaaacctttcggttaccgtggtaccggagtaacgggtgggtaccggtaagtacgaaccgttaaccgggttgggaccttacgttacgttcccgttcggtaacccgggtaacgtacggggtaaaccctaacgggtcctacccgggtttacgtttacggaccccg

SEQ ID NO: 330386 - DNA, 636 bp, Homo sapiens
  misc_feature: GZ8MTXP02HLXAN.2.76.G10.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagacgctcgacacacgaccggtgctcgatttagtcactcatacaggggggagagatcgtgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcggggtcccccgggnaggagggtcaccatctcttgtctggagcacctccaacngcgggctgaattaangtagtactggtaacaagcacggtacccaaggaaaccccgaacccccaaaactcctacaacttcctctaccaaacaaagtaaaccncgaccgccgacctacgacggtactcccgagcctnttctctccgaccctacgaacgtcccgaccacnccacnccctccgcgaccactcgacggtccgggccggtaccgggacggaggagtggtacggacgttagtaactttacgtacgtggtacggacgtaggtagtagggactacggaacgtaaccggtgggtacttactttacgtaccgttccggttacccggtaaccggtacggaacccgtacggtacccgtacccggttacggttacgaccg

SEQ ID NO: 330387 - DNA, 722 bp, Homo sapiens
  misc_feature: GZ8MTXP02FHP44.2.76.G10.1.454.CMB.2.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtctcgggtccccggnagagggtcaccatctctgttctggaggcacctcaacatcgggcgtgataatgtgtactggtacaagcaggtccccaaggaaccacccccaaatccctanatctctacaanaataactcaacgccggcccctagacgggactcccctaggacccgatttcctctcgccccttaccgaaacggtccccgggacctacccttccgacgtcccccttacccgtgggacccctaacgttccgaacgggttcgggggccccgttccccgggggtacccgaaaggggtaagttcggaacgggtccttagggtaacttttaacgtttaaccgtgggttacgaaccggtaaggggtagttacgggggtaactacgggtaaaccctaaaccgggtttcgggggtaccttaccgtttaacgttccggttaccgtttacccggggaaccgtttacgggggaaccccttaaaacgggtccccgtaaacccggtttcccgtttacgggtaaccccg

SEQ ID NO: 330388 - DNA, 581 bp, Homo sapiens
  misc_feature: GZ8MTXP02I32UA.2.76.G10.1.454.CMB.2.raw
  modified_base (223)..(223): a, c, t, g, unknown or other
  misc_feature (223)..(223): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctccaccctcctcactcactgtgcagggtcctgggcccagtctgtgctgactcagccacctcagccgtcgtcgggtccccgggnaggaggtccaccattctcttgttcgtggagcacctccaacagtcgggctgataagtgtgtacgtgtaacagcacggtacccacggaacccgaacccccaatccctcactctctacaactaatactcacgccggccctagacggtactccccagcgtacttcctctcgcctcgacgtcccgacncctcacgccctccgcgtcacgtcgacggtcggccgtcgggacgngatggngctgtactagtagtgngacgnggtagtcgggatacggacgtacgtcggtactacgttacgtccgttcgtaccggtaacggtacgggaaacctacggttacccgtacccgttcgtacggtaacccg

SEQ ID NO: 330389 - DNA, 622 bp, Homo sapiens
  misc_feature: GZ8MTXP02I6QM5.2.76.G10.1.454.CMB.2.raw
  modified_base (221)..(221): a, c, t, g, unknown or other
  misc_feature (221)..(221): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggtccagtctgtgctgactcacgccaccctcagcgtcgtcgggtccccggnaggaggtcacatctcttgtctggacgcacctccaacagtcgggctagataatgtagtactggtaacaagcacggtacccaacggaacccacccccaaatcctacactctctacaactaaataaactcaaccggcccgtaccctacgaacggtacctaccccgtagacccgtattccctctccgaccctacgaacggtcccgacctaccctcaccgcccctcccgtgaccagtcgacggtcgggaccgtccggggaccgaaggtagtggacgtcgttaggttaactttaacgttagtcggtgacggaggtaggtagggagtaccgaaacgtacggtgggtactactttacgtcttcggttaccggaaccgtacggacgtacgtccgaccgttcgtacgaccg

SEQ ID NO: 330390 - DNA, 672 bp, Homo sapiens
  misc_feature: GZ8MTXP02HKIIG.2.76.G10.1.454.CMB.2.raw
  modified_base (288)..(288): a, c, t, g, unknown or other
  misc_feature (288)..(288): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtccgtcggggtccccccgggcacggacgggtcaaccatcttcttgttcgtggacggcacctaccaacagtcgggcgtgataangtagtacgtagtacaagcacggtacccaacggaacccgaaccccctaaaacctcctactactcctactaccaaactaaataactcaacccggtccgtccccgtacgaacgggtacgtaccccgtacgtacccgtatttcctccgtccgtacccctacgaaaccggttcccgcctaaacccgtcccacgtccctcccgtcgcccatcgagggtccgggccgtcccggggacgtaggtatcggtacgcctagttaagttacttacggtgtcggagagggtatggggtataccgaacgtaccggtggggtactacttacgtcctttacggtttaccggccgtagggggtaaccctacgggttcccgtacggttcccgttaggacccg

SEQ ID NO: 330391 - DNA, 614 bp, Homo sapiens
  misc_feature: GZ8MTXP02I2M3U.2.76.G10.1.454.CMB.2.raw
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcggggtcccccgggcaggacgggtcaccatctcttgtctgggagcacctccaacagtcgggctgataatgtgtactggtacaagcacgggtacccaaggaacccacccccaaactcctacactctactcaactaataatcagccgcctcgacggacgtccctcgaccgtattctctcgccctcgaacgtcccggctacctcacgtccctcccgtggaccctagtccgacgggttcggggcccgtcccgggggaccgagggtacgtacgggtacgtcgtaggttacttaacgttcgtaggtcgacgtaggagtggtaactcggacgtaccggtgggtactctttacgtccgttcgttacggaaccggtcggaaccgtaccggtcgtacccggttcgttcggtaacccg

SEQ ID NO: 330392 - DNA, 617 bp, Homo sapiens
  misc_feature: GZ8MTXP02JK5RF.2.76.G10.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtcgtcgggtccccggnaggcggtcacntctcttgtcnggacgcacctcaacngtcgggctgataagtgtgtacgtggtacaagcgacggtacccaacggaaccccgaacccccaaactcctacactcctactcaactaataactcacggcccgaccctagacggtacctcccgttacgacccgtacttcctccgtacgtccctaaccgtaacggtcccgacctaccctcaccgtccccttccgacggcctacgtccggtacgggtccggggcctccgggggacggaggtagcggaggtcgttagtaatttaatccggtgtcgagtaggtcggagtatcggaaactcggtaggtctaagttctcgtacgtacggaaccgtacggaacctacggtccaccggttcgttaggaccc

SEQ ID NO: 330393 - DNA, 699 bp, Homo sapiens
  misc_feature: GZ8MTXP02G00ED.2.76.G10.1.454.CMB.2.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccacctcagcgtctcggggtcccccggnaggaggtcaccatctcttgtctggagcacctccaancgtcgggctagactaatgtgtacgtggtaacaaggcacggtaccccgaagggaaccccaacccccaaactccacacttcctctaccaataaacttaagtccgaacggcccggtaccctacgaacggaccgttcccccaggcccgtattccgtccgtccgtaccctacgaacggtccccggctaccctcacccgtccctcccgtcggaccctacgtcgacggggtcgggacccgtccggggaccgaggtacgtcgggtaacggtcttaggttaacgtttacgttacggtgtacgacggtaggtacggtagggtactacggtaaaccgtaccggttgggttcgtaaccttttacggttccgttacccggttacgggaacccggttacggggtaaacccgtacgggttccccgtaacccggtttccgttacgggggtaaaccccg

SEQ ID NO: 330394 - DNA, 696 bp, Homo sapiens
  misc_feature: GZ8MTXP02F62ST.2.76.G10.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtctcgggtccccggnagacggtcaccatctcttgtctggagcacctccaangtcgggctagataagtgtacgtacgtggtaacaagcacggtaccccaaggtaaaccccgaacccccctaaaacttccctactactcctacctacaaactaaataacgtccaaccgcccggccctagacggtacgtcccctagcccgtattcctcgtccgtaccctaccgtaaaccggtcccgaccctaacctccaccgtccccttcccgcggaccctagtccgtaacgggtcgggaccccgttcccgggggaccgtagggtacgtcgggtaaacgtcgttaagttacgtttaacgttacggttggacgggtaccgtagggacgttagggggaacttacggaaaaccgttacggtggggtacttactttacgtccgtaccggttacggaacccggttacggaaccgtaacggcccgttcccggttacgttagaacccccgg

SEQ ID NO: 330395 - DNA, 518 bp, Homo sapiens
  misc_feature: GZ8MTXP02FFL9V.2.76.G10.1.454.CMB.2.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
  modified_base (429)..(429): a, c, t, g, unknown or other
  misc_feature (429)..(429): n is a, c, g, or t
  modified_base (504)..(510): a, c, t, g, unknown or other
  misc_feature (504)..(510): n is a, c, g, or t
  modified_base (512)..(514): a, c, t, g, unknown or other
  misc_feature (512)..(514): n is a, c, g, or t
  modified_base (516)..(518): a, c, t, g, unknown or other
  misc_feature (516)..(518): n is a, c, g, or t
tcagacgctcgacacacgaccggtgctcgatttagtcactcatacagggtcctggggcccagtctgtgctgactcagccaccctcagcgtctgggcccccccgggcagagggtctccatctcttgttctggagtcacttccaacatcggaaataatgatgtgagctggtaccagcaggtcccaggaaccgccccccaaactcctcatctataccaatgatgtgcggccctcgacggggtccctgaccgattctctcgcctcaagtctggcacgtcagtccttccnggacatccgtggcctccagtctgcgatgaggtcttgtttattctgttcagcacggggatcgccagcgtaanggcaagtttgggatcgggagggacgggactaaggttgacccgtctaagtcacgccaggcctcgccccctgtcnctcctcgttccccaccctcctctgtcgacgtcgtcctggacggcgggcgtggacgaaggccgactagtagctagnnnnnnncnnncnnn

SEQ ID NO: 330396 - DNA, 603 bp, Homo sapiens
  misc_feature: GZ8MTXP02IEVFO.2.76.G10.1.454.CMB.2.raw
  modified_base (221)..(221): a, c, t, g, unknown or other
  misc_feature (221)..(221): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtcccccggnagagggtcacatctcttgtctggagcacctccaacatcgggctgataatgtgtactggtacagcacggtcccaggaacccacccccaaatccncactctcncaacaataacncagccgccctagacggtactcccngacccgtnttctcctcgcccctacgaagtcccggcaccctcacgtccctacccgtcgaccactcgacggtcggggccgtacccggggccgtaaggactcgggtacgtccgttaggtaatttaccgttaagttcggtggacgtaggtacggtagggtactggaacctaaccgggtggtcgtaacttcgtctttaccgtcggaaccggttcggaaccgtacggtccctaccggtttcgtacgtacccg

SEQ ID NO: 330397 - DNA, 748 bp, Homo sapiens
  misc_feature: GZ8MTXP02JU5Z2.2.76.G10.1.454.CMB.2.raw
  modified_base (222)..(222): a, c, t, g, unknown or other
  misc_feature (222)..(222): n is a, c, g, or t
  modified_base (649)..(649): a, c, t, g, unknown or other
  misc_feature (649)..(649): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcacgcgtcgtcgggtccccggngaggacgggtcaccatcttcttgttcgtggaggccaccctaccaacacgtcgggcgtagaattaactggttacgtacgtaggtaacagccgacggtaccccaacggaaaccccgaaccccctaaactcccctacactcctacctacaactaaactaaactacgaaccgtcccggaccctacgaacgggtaccgtaccccgttaggtacccgtacgtttcctcccgtcgtccccgtacccgtaaccgggtcccccgtacacccgttccacccgtccccctcccgtacggaccctacgtccggtacggggtccgggtcccggaccgggggaaccgtggaaacggttcgggaacgtcgttagggttaactttacgttaccgtggtacggacgtaggtacgggttaggacgttacggaaccgttaccgggnggttacgttaccgtttacgtcccgtttaccggaccgggttaaccggtacgggtaaaccgttcccggtaaccgtcccggtttacgggtaacgtcccccgg

SEQ ID NO: 330398 - DNA, 779 bp, Homo sapiens
  misc_feature: GZ8MTXP02GLIZ5.2.76.G10.1.454.CMB.2.raw
  modified_base (231)..(231): a, c, t, g, unknown or other
  misc_feature (231)..(231): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctgggcccagtctgtgctgactcacgcccaccctcacgccgtccgtccggggtccccccgggngacggacgggtccaacctattccttctttgttcgtgggacggcctaccctccaaacgacggtcgggcgtagtaattaagtgttacgtacgtaggtaacaaggcgtaacgggtaccccgaaacggaaaccccgaacccccctaaaacttccctacctacttcctacctaccaaactaaataaactcgaacccgcccggaccctacgaacggtaccgtcccgtacggtacccgtactttccgtaccgttccggaccccttacccggtaaaaccgggttccccgggaaccctacccgttacccgaccccgtcccccgtttcccggtaccggggaaccccttacgttacccggaacgggggttcccggggtaccccggtcccgggggaaccgggaagggtaacgtcgggtaacgggcttagggttaactttacgttacgttaggtcggacggtagggtagttaacgggacgtacggaaccgttagggtcggttacgtacttacgtcgttacgtacgaacgtcggacgtacgtcctaccggttcgtacgaccg

SEQ ID NO: 330399 - DNA, 578 bp, Homo sapiens
  misc_feature: GZ8MTXP02JES75.2.76.G10.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctcgggcccagtctgtgctgactcacgccacctcagcgtccgtcggggtcccccggnaggaggtccacntctnttgtcnggagcaccncangtcgggntnatangtanctgacagcacggtccagaacccaccccaatccnactctcacaacaatancacgccgcctagaggtcgccctagccgtnttcnctcgtccctacgacgtcccgacctaccncgacctcccttccgacgtaccacgttcgacgggtcgggacccgtccggggacgaggtagtcggaggtactagtattagttacgtgtacgagtaggtacggtaggactacggaaccgtcggtggtactacgtttcgtccgttccggttacggccggttacggaacgtacgtccgtaccgtttccggagtaccc

SEQ ID NO: 330400 - DNA, 690 bp, Homo sapiens
  misc_feature: GZ8MTXP02HJU2I.2.76.G10.1.454.CMB.2.raw
  modified_base (220)..(220): a, c, t, g, unknown or other
  misc_feature (220)..(220): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcagggtcctgggcccagtctgtgctgactcagccacctcagcgtcgtcgggtccccggnaggacggtcaccatctcttgtctggacgcacctaccaacagtcgggcgtgaataatgtagtactggtaccaagcacggtccccgaaggtaacccgaaccccctaaactcctcaactcctctacaactaaatactcgaccgccggaccctgaacggtcgtccctgaccgtactttctacctccgtaccctaccgaaacgggttcccccgaccgtacctacccgaccgtccccctacccgttccggaccctacgtccgacgggtccggggcccggttccggggaccggagggtaacgtcgggtacggtccgtaaggttactttaacgttacgttacggtacggagtaagggtaggtagggtacttacggaaccgttacggtacgggttcttacgtttacgttaccgttccgtaccgggtaaccggtaacgggaccgttaacggtccgtaacccgttcggtttacgaacccgg

SEQ ID NO: 330401 - DNA, 614 bp, Homo sapiens
  misc_feature: GZ8MTXP02JSTXL.2.76.G10.1.454.CMB.2.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctcagcgtctgggtcccccgggnagaggtcaccatctcttgtctggagcactcacntcggntgatatgtgtactggtacagcaggtcccaggaaccgacccccaaatcctacatctactcaacaataactcacgtccggaccctgacggacgtccctaggacccgtattccgtctacgcccttaccgaacgtccccggacctaccctccgacgtccctcccgtggacccactcgacggtcgggccgtcccggggaccgaggactggacggtctaggtattacgttacgtgtgcgtagggagtagggattacggaaccgtaaccggtgggtacgttacgtttaacgtccgttacgtttacccgggaaccgtacggggtaaccgtaacggtcccgtaaccggttccgtttcggtaacccg

SEQ ID NO: 330402 - DNA, 630 bp, Homo sapiens
  misc_feature: GZ8MTXP02F8T14.2.76.G10.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (509)..(509): a, c, t, g, unknown or other
  misc_feature (509)..(509): n is a, c, g, or t
  modified_base (529)..(529): a, c, t, g, unknown or other
  misc_feature (529)..(529): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcgagggtcctgggcccagtctgtcgctgactcacgcccacctcagcgtcgtccggggtccccggnaggacggtccaccatctcttgttcgtggacgccaccctcaaacngtcgggctagataagtgtacgtagtgtaacagtcacgggtaccccaaggaaccccaaccccctaaactcccacacttcctctacaactaataacgtcacggcccgacctcgacggtactccgagtcccgtattcctactcgacccttaccgaacgtcccgacctacctacgccgtccccttcgcgacccagttccgcgggtccgggcccgaccggggacgtaaggcgttagggaccggtntttaggtaacttacggttgnggtcgaacgtaggtagtagtactacggaacggttacgttggtcttacttacgtcgttcggaaccggcggtaaccgacgttacgtccgtacgtcgtacgacc

SEQ ID NO: 330403 - DNA, 583 bp, Homo sapiens
  misc_feature: GZ8MTXP02FKFK8.2.76.G10.1.454.CMB.2.raw
  modified_base (352)..(352): a, c, t, g, unknown or other
  misc_feature (352)..(352): n is a, c, g, or t
  modified_base (517)..(517): a, c, t, g, unknown or other
  misc_feature (517)..(517): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcacgcgtctcgggtcccccgggcagagggtcaccatctcttgttctggacggcacctccaacagtcgggcgtgataatgtgtactggtacaagcaggtcccaaggaccgaccccccaaactcctacactctctcacatactcacgccgccctnaggctcccctgaccgattctctcgcctacagtcccgacacctcacgccctcccgtagcccattccgaggtcgggcctacccgggggacctaggacttggacggcctttagggactttacttaccgtgtagccgaaggatcggggatcgaactaaccgtgggtacnctttaacgtcctaccgttcggaacccgtcggggtacccaacggttcacccggtacttcgggacccg

SEQ ID NO: 330404 - DNA, 706 bp, Homo sapiens
  misc_feature: GZ8MTXP02IVZLL.2.76.G10.1.454.CMB.2.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagccgtccgtccggggtccccccgggnaggagggtccaccatccttctttgtctgggacgccacctccaacngtccgggcgtgataatgtgtactggtaacagcacggtccccaaggaaaccccaaccccccaaatcctacactctctaccaataataatccacggcccggccctacgacggtaccttccccgtacgcccgtatttcctccgtcgtccccctaccgaaccgggttcccggacccaacccgttccaccgtccccgttcccgtcggaccctacgtcgtacggggtccggggtcccgtacccgggggaccggtaagggtacgtacggggacggtccgttaggtaacttttacgttaccgtggtacggacggaagggttaggtaggggtactacggtaaaccgtaccgggttggggtcttactttacgtccgtttccggttaccggtaaccgtacggaacccgtaacggtccctacccggttccgttacggtaacccg

SEQ ID NO: 330405 - DNA, 806 bp, Homo sapiens
  misc_feature: GZ8MTXP02IYX42.2.76.G10.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagacgctcgacacacgaccggtgctcgatttagtcactcatacaggggggagagatctgggggaagctcagcttcaggctgtgggtagagaagacaggattcaggacagtctccagcatggccggcttcctctcctcctcaccctcctcactcacgtgtgcagggtcctgggcccagtctgtgctgactcagccacctcagcgtctcggggtcccccggnaggacgggtcaccatctcttgtctggacggcacctcaangtcgggctagataatgtagtacgtggtacaggctaggtccccaggaacccaacccccaactcctctactctcacaactaatactcgacgccgccctagacggtactccccgtagacccgtactttcgtaccttccgcccttaccggaaaccggttccccggggtacccaaccccgttccgtaacccggtcccccttcccccggttacgggaccccttaacgtacccggtagggggtcccgggggttacccgggtacccgggggtacccggggaaaggggtaccggttagggggtaacggtccgttaagggttaaactttaccgtttaaaccggttgggttacgggaaccggttaggggaaaccgggtttgggggaaccgtttaacggggaaacccgttaaaacccggggttgggggttccgtttaaacggtttaccttcccgttacccggtttacccgggggaacccggtttacgggggaaaaccccgttaaacggggtaccccgttaacccccggtttcgggttttacccggtaaacccccggg

SEQ ID NO: 330406 - DNA, 625 bp, Homo sapiens
  misc_feature: GZ8MTXP02F7RET.2.76.G10.1.454.CMB.2.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (468)..(468): a, c, t, g, unknown or other
  misc_feature (468)..(468): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcgggtccccggnaggaggtcacntctcttgtctggngcacctcaacngtcgggctgataagtgtagtacgtaggtacagcacggtcccaggaaccacccccaaactcctctatctactacaacaatactcaacgccggcctagacggtcgtccctgaccgtacttccgtcttcgccctacgaacggttcccgactacctccacgtccctccgtcgaccacgtcggtaggtcgggccgtccggggaccgtaaggcgtggngtactaggtatttacgacgttggacgagtaggtagtaggtacgtacgtaaccgtaaccgggttgggttaccgttaacgtttacgtccgttcggtttaaccggccgggttaacgggaaccgttacggtcccgtaaccgtttccggtacggtaaccccg

SEQ ID NO: 330407 - DNA, 770 bp, Homo sapiens
  misc_feature: GZ8MTXP02J1ZNK.2.76.G10.1.454.CMB.2.raw
  modified_base (223)..(223): a, c, t, g, unknown or other
  misc_feature (223)..(223): n is a, c, g, or t
  modified_base (440)..(440): a, c, t, g, unknown or other
  misc_feature (440)..(440): n is a, c, g, or t
  modified_base (610)..(610): a, c, t, g, unknown or other
  misc_feature (610)..(610): n is a, c, g, or t
tcagacgctcgacacacgaccggtgctcgatttagtcactcatacaggggggagagatctggggggaagctcagcttcagctgtggtagagaagacaggattcaggacagtctccagcatggccgcttccctctcctcctcaccctcctcactcactgtgcagggtcctcgggcccagtctgtgctgactcacgcccacctcagcgtcgtcggggtccccggnaggacggtccactattcttcttgttcgtggacgcctaccctacaacgtagtcgggcgtagattaatggttcgttacgtagtaaccgaaggccgtacgggtaccccgaacgggaaaccccaaacccccctaaacttcctacctaagtccttacacaaactaaataacgtccaccggccccggtacctacggaacggtaccgttcccgtacgacccgtnttaccctctccgacccttacccgaaaccggttcccgaccctccctaccgacccgtccctcccgccgtccctacgtaccggtcggtaccgggtcccggtaccgggggtcccggaaggtaccggttagggaccggttacttacggttaacgttttaacgtcggtttaccggnggttaacggaaggtagggtaacggtacgtacggtaaaacccggttacgggtcggggtttacctacgtttaaccgtccgtttacccggttaccggggaaccggtttaaccgggaaacccggtttcggtaccccgttaccggtttacggttaccggaacccg

SEQ ID NO: 330408 - DNA, 674 bp, Homo sapiens
  misc_feature: GZ8MTXP02HZO99.2.76.G10.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (371)..(371): a, c, t, g, unknown or other
  misc_feature (371)..(371): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggccccagtctgtgctgactcacgccaccctcagcgtcgtcggggtccccggnagacgggtcacctatctcttgtctggacgcacctcaanatcgggctgatatgtgtactggtacagcaggtcccaggaaccgacccccaaatcctcacttcactcaaacaatatcacgccggccctcgaggacgtcccgtagaccgttnttacctctcgtccctaccgaacgttcccggaccctacctccgacgtccccctcccgtcgggtaccctacgttaccgacgggtccggggtcccggttccccgggggacgaacggggtacgttacggggacgtccgttaggtactttaacgttactgggtcgtacgtaagggtggtaaggggacgttacgggaccgtaaccgggtttggggttacggtaccttttaacgtcgtttaccggttacggaacccggtttacggaaccgtaaacgggtcccgtaacccggtttccgtacggttaacccg

SEQ ID NO: 330409 - DNA, 630 bp, Homo sapiens
  misc_feature: GZ8MTXP02GWRLH.2.76.G10.1.454.CMB.2.raw
  modified_base (223)..(223): a, c, t, g, unknown or other
  misc_feature (223)..(223): n is a, c, g, or t
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccaccctcagcgtcgtcggggtcccccggnaggagggtccaccatctcttgttctggacggcaccctacaacagtccgggctgataagtgtgtacgtggtaacagcacggtcccaaggaacccaaccccaatccnactcctcacaactaatactcacgccgaccctgaacggtacctcccagaccgtntttcctctccgccctacgaacggtcccgaccaccgtccgacncccccgtccgtccggactacgtcgacgggtcggacccgtccgggacgaggtacgtgggaggtcctaggttacttagttacgtggtacgacggtaggtagtgggtactacggtaaacgtaccgggtgggttacttacgttcgttccgttccggttaccggaaccggtcggaaccgtaacggtcctaccggttcccggttaggaacccg

SEQ ID NO: 330410 - DNA, 758 bp, Homo sapiens
  misc_feature: GZ8MTXP02IOXM8.2.76.G10.1.454.CMB.2.raw
  modified_base (223)..(223): a, c, t, g, unknown or other
  misc_feature (223)..(223): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccacctcagcgtcgtccggggtcccccggnacggacggtcacctattccttcgtttgttcgagggtacggccaccctaccaacagtcgggactagataacgtgtcgtacgtacggtaacaacgtcgtacgggtaccccgaacgggtaaacccccgtaacccccccaaaactttcccctactaacttcccttacctaacctaaacgtaaaataaacgtaccgaacccggaccccgtacccccgttagaacggggttaccgtccccgttacggacccgtatttacccctcgtaccgtaccccctacgtaacccggttcccgaccctacccgtaccgaccgtcccctcccgttcgacctacgtcgtaacggtcgggtaccgccggggacgtaaggtcgtacggtacggtacgtttagttaaacgtttcgttaacggtgttacggacgtacggtaggttaggaacgttcgaaccgttaaacggtcgggttactacgtttaccgtcgtttaccggtacggtaaccgtcgggtaacctacggtacgttcccggttaacgttcgtaacccgg

SEQ ID NO: 330411 - DNA, 571 bp, Homo sapiens
  misc_feature: GZ8MTXP02GLOBB.2.76.G10.1.454.CMB.2.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (475)..(475): a, c, t, g, unknown or other
  misc_feature (475)..(475): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccacctnagcgtctcgggtccccggnagaggtcaccntctctgtcnggagcactcaacngtcgggctgataatgtgtactggtacagcaggtcccaaggaaccaacccccaaatcctcactctctcaacaataacncacgccgcctgaggtacgtcccngaccgnttctctcgcctcaagtcccgacacctcgacgccctcctcgaccctactcgacggtcggccgtccgggaccgtagggactgggacgtcgtagatttacgtacgtgtacgagagagtgggntacggactaaacggtgggactctttacgtccgttcgttaccggaaccggtcggtaacctaaacgggtcccgtaaccgtttccggtttacggaaccg

SEQ ID NO: 330412 - DNA, 670 bp, Homo sapiens
  misc_feature: GZ8MTXP02FE6RO.2.76.G10.1.454.CMB.2.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (364)..(364): a, c, t, g, unknown or other
  misc_feature (364)..(364): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtcgtcgggtccccggnagagggtcaccatctctgttctggagcacctcaacagtcgggcgtgaataatgtgtactggtaacaagcacggtcccgaaggaaccgaacccccaaaactccctacaactctctacacaaagtaactcaaccgtccggcccctnagggtaccgtccccctggaccgattctacgtcgtcccttaccgaaacggtcccggacctaacccgtcgaacgtccccttcccgtcgggaccctaacgtaccgacggggttcgggcccgtccccgggggaccgtagggaacgttcggacgggtcttacgggttaattaaacgtttaccgtaggttcgacgtaaggaaacggttggggataacggaaaccgaaccgttggggtactactttactccgtaccggttacggaacccgttagggaaacctacgggtacctaccggttccgttcggaacccg

SEQ ID NO: 330413 - DNA, 657 bp, Homo sapiens
  misc_feature: GZ8MTXP02HWPQD.2.76.G10.1.454.CMB.2.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (604)..(604): a, c, t, g, unknown or other
  misc_feature (604)..(604): n is a, c, g, or t
tcagacgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctnagcgtcgtcgggtccccggnaggacggtcacatctcttgttcnggacgcacctccaacngtcggctgatatgtgtacgtgtacagcgacggtcccaaggaacccgaaccccctaaactccccgtacactcctctactaacaaactaactacaaccggtccgacccctcggaacggtacgttcccgtgacccgtatttcccgtctcgcccttacccgaaacggttcccggaccctaacccttccgaacccgtcccccgtttaccccgcggtaccctacgttccgacggtccggggtcccgtacccgggggtccggacgtagttagggcggaccttgggtaactttacgtacgtgttacgacgtaggaacgttgggaactcggacgtaaccgtggtagtcctttacnccgttacgtccggtaactcggggaactacgtacgcccggttcgttacgacccg

SEQ ID NO: 330414 - DNA, 636 bp, Homo sapiens
  misc_feature: GZ8MTXP02FRCFQ.2.76.G10.1.454.CMB.2.raw
  modified_base (225)..(225): a, c, t, g, unknown or other
  misc_feature (225)..(225): n is a, c, g, or t
  modified_base (457)..(457): a, c, t, g, unknown or other
  misc_feature (457)..(457): n is a, c, g, or t
  modified_base (553)..(553): a, c, t, g, unknown or other
  misc_feature (553)..(553): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgcccaccctcagcgtcgtccggggtcccccggngacggagggtccaacctattcctcttgttcgtgggaggccacctaccaactgtcggacgtagataatgtagtacgtggtaacagcgacggtacccgaacggtaacccaacccccaatccctctactctctacaacaataactcgaccgccgccctgacggacgtccctgaccgtattctcgtcctacctacaaaccggtcccgactaccgtccacgcccctacgtccgaccncgtacgacggtccgggtccgcccggggacggtaacggatacgggtgtacgttagtaagtttacttacggtgtacggacggaggtggtaacgggttnacggtacgtaaccggtggtcgttacgttactcgttacgtaccggtaacgtacggaacgtacgtacctaccgttcgtcgtaccg

SEQ ID NO: 330415 - DNA, 691 bp, Homo sapiens
  misc_feature: GZ8MTXP02FGB24.2.76.G10.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcaggtcctgggcccagtctgtgctgactcagcccaccctcagcgtcgtcgggtccccggnagaggtcacatctntgtcnggagcacctcaacagtcggcgtgataatgtgtactaggtacagcacggtcccaaggaaccacccccaaactcctacatctctacacaaatacgcacgccgccctgacggtactccctagcgtacgactttctccgtctcctaccgaaacgtcccggtaccaacccttcgaccgtcccgtacccgtcggaccctacgtccgtacgggttcgggcccgtccccgggggacggacggtaggtacggaacggtccgttaaggtactttaacgtttaccgtggtacgacgggtaaggtacggtaagggacgttacgggaaaccttaaaccggggttcggggttaacttaccgttttaaacctacccggtttccgttaacccggggtaacccggttacggggtaacccggtaaaaccgggtttcccgtaaacccccgggtttcggtttaaaccccggg

SEQ ID NO: 330416 - DNA, 638 bp, Homo sapiens
  misc_feature: GZ8MTXP02FJVSI.2.76.G10.1.454.CMB.2.raw
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtccgtcgggtccccgggcaggacgggtccaccatctcttgttctggagcacctccaacagtcgggcgtgataatgtgtactggtaacaagcacggtccccaaggaacccgaacccccaaactccctctactcctctacaacaataactcacgcccggccctgacggacgtccctgaccgtacttctctcgtccctaccgacggtcccgacctaccctcaccgtccctcccgtcgcccatccgaggtcgggcccgtaccggggcgaggactggagtcttagtatttacgttacgtggtacgcgtagggtagtggggtaatacggtaaccgtacgggttcgggttactacgtttacgttcccgttacggtttacccggaacggttcggggaaaccctacgggttaccccgtaccggtttccggttcggtaaccccg

SEQ ID NO: 330417 - DNA, 624 bp, Homo sapiens
  misc_feature: GZ8MTXP02JMTWX.2.76.G10.1.454.CMB.2.raw
  modified_base (226)..(226): a, c, t, g, unknown or other
  misc_feature (226)..(226): n is a, c, g, or t
  modified_base (456)..(456): a, c, t, g, unknown or other
  misc_feature (456)..(456): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (528)..(528): a, c, t, g, unknown or other
  misc_feature (528)..(528): n is a, c, g, or t
tcagacgctcgacacacgaccggtgctcgatttagtcactcatacaggggggagagatcgtgggggaagctcagcttcagctgtggtagagaagacaggattcaggacagtctccagcatggccggcttccctctcctcctcaccctcctcactcactgtgcgagggtcctgggcccagtctgtgctgactcagcccaccctcacgcgtcgtcggggtcccccggnaggacgggtcaccatctcttgtcgtggagcacctcaacagtcgggctagataagtgtagtacgtaggaacaagtccgacggtacccgaacggaacccaacccccctaaactcccactacttcctactaccaaacctaaataacgtccaaccggtccccgccctacgaacggtacgtccccgtacgacgtacttctccgtacgcccttaccgaaacgtcccgacctacccnccgaccgcccttcccgcgacctacgcgtcggcggcgtccgggacgngtancggagctagtatttactgtgancggaggtgtaggtacacgggactacgggtggtactcgttagtccgttcgtaccggaacgttcggaaccgtacggtcctacccgtcgtttcgaaccg

SEQ ID NO: 330418 - DNA, 722 bp, Homo sapiens
  misc_feature: GZ8MTXP02J2QIV.2.76.G10.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcacgccaccctcagcgtcgtcggggtcccccgggnaggacggtcactctctcttgtctggacgcacctcaacngtcgggctagataagtggtntacgtggtaacaggccacggtaccccaaggaaccccaacccccgaaactcccgtacaccttaccttccgaccaaacgtaaactaacgtccgaacccggtccccggtaccccttacggaacgggtacccttccccgtacggtacccgtactttcccgtccgttccgccccttaaccgaaaccggggtcccccgaccctaaccccgtccgtacccgtcccccttcccgtacggccctacggtacggtacgggtcgggtccccggtaccgggggacccgtaaagggtccgacgggtacggtactacggttaactttagtccggttggtacggacgtaggtacggtaggactacgaaaccggttacggtgggttacctcgttactccgttccggtacgtcccgggtacgtaccgtacggtcctaaccggttcgttacggacccg

SEQ ID NO: 330419 - DNA, 776 bp, Homo sapiens
  misc_feature: GZ8MTXP02F4OCQ.2.76.G10.1.454.CMB.2.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcgacgccaccctcagccgttccgtccggggtcccccggnaggacgggtcaccgatctcttgttctggagcacctcaacngtcgggctgatacgtgtctacgtggtacagcacggtaccccaaggaacccgaacccccaaacgttcccctactactcctacgtacctaacaaatactcgaacgtcccggtcccctagacggggtacctaccccgtacgtacccgttcgttccttccgtaccgtcccccgttaccgaacggttcccccggaccctaacccttcccgaaacccggtccccctttcccccgtaggggtaccccctaacgttccgtaacgggggtcccgggtacccgggttaccccggggtaccggaaagggtacggtttacggggacgggttacccgttagggtttaaactttaaccgttttaaccggtgggtttacggaacggtagggtaacggtttaggggacgttacgggaaacctttaaccggggttggggtacttaaccgtttcgttacgttcccggtaacggtaaccggtaccggtaacgttacggtacccgtcggttaccgttacgggtacccg

SEQ ID NO: 330420 - DNA, 701 bp, Homo sapiens
  misc_feature: GZ8MTXP02F6M9K.2.76.G10.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (410)..(410): a, c, t, g, unknown or other
  misc_feature (410)..(410): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagcccacctnagcgtcgtcggggtcccccggnaggacggtcactatctcttgtcgtggacgcacctcaacngtcggacgtnaataagtgtagtactggtaacagtcgacgggtaccccgaaaggaaaccccgaacccccctaaattccctacacttcctacctacaaacctaaataaactccgaacgcccgtccctagacggtacgtccctagacccgtnttccgtactccgtacccgttaaccgaaccgggttcccgactaccctacccgaccgtccctacccgtcggaccacgttcgacgggtcgggtacccgtaccggggccgtaaggtagtcgggaacgtcttagttaacgtttacgttacggtagttcggaacggtaggtaggtggggtacttacggaaaccggttacggttaggggttcttacctttacgtaccgttccggttaaccggaacggtaaccgggaacggttaaccggtccgtaacccggttacgtttccggaaaccg

SEQ ID NO: 330421 - DNA, 601 bp, Homo sapiens
  misc_feature: GZ8MTXP02H6402.2.76.G10.1.454.CMB.2.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
  modified_base (538)..(538): a, c, t, g, unknown or other
  misc_feature (538)..(538): n is a, c, g, or t
tcagacgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtccccgggnagagggtcacatctcttgttctggaggcacctccaacagtcgggacgtgataagtgtagtactggtaacagcgacggtacccaggaaacccgacccctaaactccgtcaatctacncaaacataaactcgaacgccggccctgacggtacgtccccgagccgtacttctccgtcgtccctacgaaacgtaccgccaccctcgccnccctcccgtgccctattcgaggtcgggcctaccggggcggacgagtggacgcgtgtacttactaacgngtgacgtgagtcggtacgtacgacgtacgtggtcgtaacgtttcncgttcgttaccggaacgtaccggggaaaccgtacggtaccgtcccgttcggtttcgaacccgg

SEQ ID NO: 330422 - DNA, 763 bp, Homo sapiens
  misc_feature: GZ8MTXP02JSWR5.2.76.G10.1.454.CMB.2.raw
  modified_base (184)..(184): a, c, t, g, unknown or other
  misc_feature (184)..(184): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
tcagacgctcgacacacgaccggtgctcgatttagtcactcatacagggggggagagatctggggggaagctcagcttcagctgtggtagagaagacaggattcaggacagtctccagcatggccgcttccctctcctcctcaccctcctcactcactgtgcagggtcctgggcccagtctgtnctgactcacgccacctcagcgtcgtcggggtcccccggnaggacggtccaccattctcttgttacgnggacgccaccctcaacaggtcgggctanactaatgtntacgtgaacagccaggtcccaggaacccaaccccaatccanactctactacaaactagtactcgaccggcccgtacctacgacggtccttaccccgtcggaaccgttccttccgtcccgtttaaccgcccttaaccccggtaacgtcccccgggtacctacccccggttacccgacccgtacccccgtcccggtaccgtaccctaccggttacgggtacggggtcccgggtacccggggtacccgggggacggggtacggtaacggtacgggtacggtacgttaggtttactttaacgtttacggtaggtacgggaacggttaacggggtagtcggggtaactaaccggtaaccgggttacggggttacggttacttacgtttacccgtcggtttacccgggttacccgggtaaccggtaccgggtaacccggttacggttacccggtacccggtttaccgggttaccgaacccg

SEQ ID NO: 330423 - DNA, 727 bp, Homo sapiens
  misc_feature: GZ8MTXP02FR7X9.2.76.G10.1.454.CMB.2.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (531)..(531): a, c, t, g, unknown or other
  misc_feature (531)..(531): n is a, c, g, or t
tcagacgctcgacacacgaccggtgctcgatttagtcactcatacaggggggagagatctggggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagagggtcaccatctctgtctggagcaccncaanactcgggcgtgactaatgtagtactgtaacaagcgacggtcccaaggaacccgacccccaaaatcctacatctctacaacaaataatcacgccgcctnaggtacgtccncgaccgtattctntcgtccctacaacggtccgacactccagtccctaccgcgtacccattacacggggtcggtaccggtcccggggacccggtaaagggtacgtacggggtaacggtcccgttaagggttaaacctttaacgtaaccgttacggttacggaaaccgngggggtaaaccgttaggggtaaaccgttacgggaaaacccggtaaaccgggtttcgggggttacgttaaacccgttttttaaactcccgttaccgggttttaaacccgggggaaccccgttaaacggggggaaaaccccgtaaaaccgggggttacccgtaacccgggttttccccggtttaacggggtaaacccg

SEQ ID NO: 330424 - DNA, 588 bp, Homo sapiens
  misc_feature: GZ8MTXP01DNFDR.9.15.B04.1.454.CMB.2.raw
  modified_base (510)..(510): a, c, t, g, unknown or other
  misc_feature (510)..(510): n is a, c, g, or t
tcagtgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggccccagtctgtgctgacgcagccgccctcagtgtcgtggggccccagggcagaggtcaccatctcctgtctgggagcagctccaacatcgggggatactctgatgcacattggtatcagcagcttccagaacgcacgaccccccaaactcctaccactctatcgacctaaaccaacccaactccggccctcgacggggtcccctacgaccgtattctctggctccaagtctggcaccgtcacgcctccctagacctaatccgaagtgtaaattcgacagactggaagtagtagacggtacctaaacttaacctaacgttcgacccgttacgtaccccgtccggaaccncggttaccaacggtcccggttgggggtttccgggtttgggggttacggttttcccggggaacggggtaaaccccgggg

SEQ ID NO: 330425 - DNA, 567 bp, Homo sapiens
  misc_feature: GZ8MTXP01CBL56.9.15.B04.1.454.CMB.2.raw
tcagtgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgcctcagtgtctggggccccagggcagaggtcacatctctgttctgggagcagctccaacagtcgggggatacgtctgatgcacattggtatcagcagcttccagaagcacgcccccaaactcctacactctatcgactaacaaccaaactccggccctacgacggggtcccctagaccgtattcctctggactccaagtcctggaccaccgtcacgtcccctccctacgacccacttaccgaagttagtaaacttcggaccaacgaccgtggaagtacgtaggaacgtacctaaactaactaacgttcgacccacgttaccctccgaacgcggcctaaggtccgtggggtttcggttgggttcggttcgggcgggtaaccggg

SEQ ID NO: 330426 - DNA, 564 bp, Homo sapiens
  misc_feature: GZ8MTXP01EFWGR.9.15.B04.1.454.CMB.2.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagccgccctnagtgtctgggccccagggcagaggtcacatctctgtctgggancagctcaacagtcggggganactctgatgcacattgatcagcagctaccagacgcacgacccccaaatcctnactctatcgacctaacaaccaactccggccctcgacggggtccctagaccgtattcctcgtgcctacgtaagtctcggaccacctcaccgtcccttcccngaaccntcgaagtcgaattgctaagacgtggaagtacgttggaacggtaccttaaactaaccgttacgttccgcccgttaacgttccctaccggaacttcggactaacggtccgttggggttcggttttcggggttacggttccgggcgggtaaccggg

SEQ ID NO: 330427 - DNA, 642 bp, Homo sapiens
  misc_feature: GZ8MTXP01B7F71.9.15.B04.1.454.CMB.2.raw
  modified_base (233)..(233): a, c, t, g, unknown or other
  misc_feature (233)..(233): n is a, c, g, or t
tcagtgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtcgtggggccccagggcagaggtcaccatctcctgttcnggagcagctccaacatcggggatactctgatgcacattggtatcagcagcttcagaagcacgacccccaaactcctcactctatgactaacaaccaactccggccctcgacggggtccctcgaccgtattcctcgttcggcctaccgaacgttccgttacgggaccctaacccgttccgaaccggtccccttccccgtacggtaacccctacgttacccgtaaggtttacgtaaaccgtttcgaaccgtaacggtaacccggttaggaaacggtagtttacgggaacgggtaccttaaaccttaacccgtacgttaccggacccttacgtaccccgtcccgaaccgacgccgtaacgtccggttggggttcgggtttcggggttcggtttccggggcggggtaaccggg

SEQ ID NO: 330428 - DNA, 607 bp, Homo sapiens
  misc_feature: GZ8MTXP01A45VS.9.15.B04.1.454.CMB.2.raw
  modified_base (192)..(192): a, c, t, g, unknown or other
  misc_feature (192)..(192): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (443)..(443): a, c, t, g, unknown or other
  misc_feature (443)..(443): n is a, c, g, or t
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
tcagtgatacgtctcacgaccggtgctcgatttagacagtatatatccggcgggggggctctgcttcagctgtgggcacaagcggcagcactcaggacaatctccagcatggcctggtctcctctcctcctcactctcctcgctcactgcacagagtcctgggcccagtctgtgctgacgcacgccgccctnagtgtcgtcggggcccagggcagaggtcactntctctgtcgnggacncagcctaccaacgagtcgggggatactcgtgatcgctactagttggtatcgagctagccttaccgaagtaacgccaccgaccccctaaactcctacaccttctatcgacctaaccaaaccctaacgtcccgacccgtacggtaccgggtccctgacccgtacttccgtcgtcgtacctaccgtaacgtccgtcggaccctaccnccgtaccgtccccttcccgaccgaacctcgtaccgagtacgtaactcganagtacgtgacgtatggaactacttaacaacctanccggaccttcgtaccacgcgcgacgtaacgtccgggttggggttgttcggggttacgggttccggaacggggtaacccgg

SEQ ID NO: 330429 - DNA, 503 bp, Homo sapiens
  misc_feature: GZ8MTXP02FXPTX.9.15.B04.1.454.CMB.2.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (458)..(458): a, c, t, g, unknown or other
  misc_feature (458)..(458): n is a, c, g, or t
tcagtgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagaggtcaccatctcctgttcngggagcagctccaacagtcggggganactctgatgcacattggtatcagcagcttccagaagcacgcccccaaatcctcactctatgactaacaccaatccggccctcgacggggtccctgaccgattctctacggcctccaagtctgccacctcacgccctccctgacccatccagtgaattgacagactgaggatgagctaactactactgccagtcctccgacncgcaacgtccgtgggttcggtttgggtcgttcgggcggtaacggg

SEQ ID NO: 330430 - DNA, 662 bp, Homo sapiens
  misc_feature: GZ8MTXP02IV35D.9.15.B04.1.454.CMB.2.raw
  modified_base (260)..(260): a, c, t, g, unknown or other
  misc_feature (260)..(260): n is a, c, g, or t
tcagtgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtcgtggggccccagggcagagggtcaccatctcctgttcgtgggagcagctccaacgagtcgggganactctgatgcacattggtatcgagcagtcttaccagacgcacgacccccaaactcctacactctatcgactaacaccaatccgccctcgacggggtccctgaccgtattctcgtcggcctaccgaagtccgtacggacctaccctcgacgtcccccttacccgtacgtaaccctacttaccgaacggttacgtaaacgtttcggaaccgtaaacggtaccgttagggaagggtaacgttacgggaaacgggtaccctttaaaaccgttaccttaaccgttaccgacccgttaaaccgggttccccctacccggtaaaccgtacgacccgtaacggttcccggtttgggggtttacgggttttcgggggttcgggtttaccgggggaccgggtaaacccgggg

SEQ ID NO: 330431 - DNA, 480 bp, Homo sapiens
  misc_feature: GZ8MTXP02FM8I9.9.15.B04.1.454.CMB.2.raw
  modified_base (236)..(236): a, c, t, g, unknown or other
  misc_feature (236)..(236): n is a, c, g, or t
  modified_base (287)..(287): a, c, t, g, unknown or other
  misc_feature (287)..(287): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
tcagtgatacgtctcacgaccggtgctcgatttagacagtatatatccgcgggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggancagctccaacatcggggagactctgatgcacattggatcagcagctcagancagcccccaaatcctcactctatgctaacaccaatccggccctcgaggggtccctgaccgattctctggcctccaagtctgcacctcagcctcccngacccngtcagtgaattgacagactgaggatgacggctaactactactgcccagtcctaccgacngcaagtcgtggtcgttggtcgtcggcggacgg

SEQ ID NO: 330432 - DNA, 599 bp, Homo sapiens
  misc_feature: GZ8MTXP02GM6PE.9.15.B04.1.454.CMB.2.raw
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (458)..(458): a, c, t, g, unknown or other
  misc_feature (458)..(458): n is a, c, g, or t
tcagtgatacgtctcacgaccggtgctcgatttagacagtatatatccggcggggggctctgcttcagctgtgggcacaagcggcagcactcaggacaatctccagcatggcctggtctcctctcctcctcactctcctcgctcactgcacagacgtcctgggcccagtctgtgctgacgcacgcccgcctcagtcgtcgtcggggccccagggcaggaggtcacatctctgtcgnggancagctaccaagagtcgggganactcgtgatgacacgtagttggtatcgagcagtctacgagacgccaccgaccccaaactcctacactctatcactaacaccgaacgtccggacctacggaccggggtccctagaaccgtcttccgtcgtcgtccctaacgtacgttcgaccgcctaccctcgaacctccctaccagacctatacgtaacgtgtaacncggacaacgttacgaggacgtacgtacggacgtaactaacttacacgttcgacccgtaccgttaccgaccgaactcggaccgtcggtccgggtttggggtttacgggttcggggtacggttaccggggacggtaacccggg

SEQ ID NO: 330433 - DNA, 504 bp, Homo sapiens
  misc_feature: GZ8MTXP02JJYTM.9.15.B04.1.454.CMB.2.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtgatacgtctcacgaccggtgctcgatttagacagtatatatccgcgggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggancagctccaacatcggggganactctgatgcacattggtatcagcagcttccagancacgcccccaaatcctnactctatgactaacaccaatccggccctgacggggtcccctgacccgtattcctctcggccttaccaagtcttgggccaccctcacgccctaccctgacccntccagtcgaattgctagactggagatggagctaactactatcgaccagttccncgaacncgacaacgtcgtggtcgttggcgtcggacggacgg

SEQ ID NO: 330434 - DNA, 623 bp, Homo sapiens
  misc_feature: GZ8MTXP02ITJSG.9.15.B04.1.454.CMB.2.raw
  modified_base (236)..(236): a, c, t, g, unknown or other
  misc_feature (236)..(236): n is a, c, g, or t
tcagtgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtcgtcggggccccagggcaggagggtcaccatctcctgttcgngggagcagctccaacagtcggggagactctgatgcactattggtatcagcagctcagacgcacgacccccaaactcctcactctactgactaacaccaactccggccctcgaccggggtccctgaccgtacttctcgtcgtctaccgaagtcctcggccacccttacaccgtcccctcccgtcaaccctactaccgagttacgaaagtttcggactaacggtaccgtagggaacggtaagtgggaacggtacttaaaaccgttaccttaaccgttaccggaccccgtaacgttcccccgtaccgtaaccgacggaccgtaacggtcccgggtttaggggtttcgggttttggggttcggtttaccgggggaccgggtaacccggggg

SEQ ID NO: 330435 - DNA, 638 bp, Homo sapiens
  misc_feature: GZ8MTXP02FQLRB.9.15.B04.1.454.CMB.2.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
tcagtgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagcccgccctcagtgtctcggggccccagggcagagggtcaccatctcctgttcgtgggagcagctaccaacgagtcggggganactctgatcgcactattggtatcagcagcttaccaagaacnccaaccgacccccaaactcctacactactatacgacctaaaccaccaactcccgggcccctacggtaccggggttccccctacggaacccgtactttcccgtccgtcggtaccctacccgtaaacgtccgtacggaccctaccccttaccgaccgtcccccttacccgaccgtaacccgtaactaccgtaaggttacgtaactttacgacgacgacgttaggacgtaagtaggaacgtacctaaactactaccgtcgaccgtacgttcccaccgaaccgacgacgtaacgtcggttagggtttcgggttcgggtacggtacgggacggtacgg

SEQ ID NO: 330436 - DNA, 520 bp, Homo sapiens
  misc_feature: GZ8MTXP02FGAD6.9.15.B04.1.454.CMB.2.raw
  modified_base (315)..(315): a, c, t, g, unknown or other
  misc_feature (315)..(315): n is a, c, g, or t
  modified_base (426)..(426): a, c, t, g, unknown or other
  misc_feature (426)..(426): n is a, c, g, or t
tcagtgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacagtcgggggagactctgatgcacattggatcagcagcttcagagcacgcccccaaatcctcactctangctaacaccaatccgccctcgacggggtccctgaccgtattctctggcctaccgaagtctaggcacctcacgccctccctgacccatcagtgaattggcagactgaggtanagacgtactaactactacgcgacctacgtcccaccgacacgcgaacggtcggttggggttacggtttcggggtcggtaccggggacgggaacgg

SEQ ID NO: 330437 - DNA, 702 bp, Homo sapiens
  misc_feature: GZ8MTXP02F5XQP.9.15.B04.1.454.CMB.2.raw
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagtgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcacgccgccctcgagtgtccgtcggggccccagggcaggnggtcacatctctgttcgtgggagcagctaccacgagtcgggganctcgtnagtgactacgtattcggtatcacggactacgtacctacccgaaaggtaaccgaccgaaaccccgtaaccccccctaaaacgtccccttacaaccgttacctactacggtaacccttaaaacccacccgtaaacgtcccccggggtaccctaccgggtaaccgggggttaccccctaggtaacccgttactttaccgtacccgtcggtacccttaaccgtaacggttccgacggtacccacccttacgccgtcccttacccgtaccgacctactacgtacgtacgtaccgttagtacgacgtacgtaggaggtagacgtaacgtactaactaactacgtacgacgtaccgttaccgaccgaccgtaacgacgtaacggtaccggttacgggttacgggtttaggggtcgggttacgggtacgggtaacccgggg

SEQ ID NO: 330438 - DNA, 510 bp, Homo sapiens
  misc_feature: GZ8MTXP01BV920.21.52.E08.1.454.CMB.2.raw
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagtcgtcgctcgcacgaccggtgctcgatttagtcgagctctcagagagaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttatttttacacgccccaccaataagagctactagcttggtccagcacaaaccaggacagcctctgtaatgctctatttacgtggcgtcgtacccggatagtcgggtccctgaccgatcaagtggcgagcgggtcgtgggacagtatttcactctcaccatcaagcagcctgcaggctagaagngtggtgctagtttatacgtgtcagntaatattatattcnccttgaacgttcgttcggacaagggccaggggtgaaatcgaaaagacttgtgcctg

SEQ ID NO: 330439 - DNA, 511 bp, Homo sapiens
  misc_feature: GZ8MTXP02FRW22.21.52.E08.1.454.CMB.2.raw
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (500)..(500): a, c, t, g, unknown or other
  misc_feature (500)..(500): n is a, c, g, or t
tcagtcgtcgctcgcacgaccggtgctcgatttagtcgagctctcagagagaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttatttttacagccccaccaataagagctacttagcttggttccagcacaaaccaggacagcctcctgtaatgctcatttactgggctctaccggaatacgtcggggtccctgaccgattcagtggcagcgggtctgggacagtacttcactctacaccatcagcagcctgcaggctagaanatggngctaggtttatactgtcagctaatattatattctctcagtacgttcgactaaggggaccagggtaagaaaactcgaaaacgntagcggctacg

SEQ ID NO: 330440 - DNA, 559 bp, Homo sapiens
  misc_feature: GZ8MTXP02F9014.21.52.E08.1.454.CMB.2.raw
tcagtcgtcgctcgcacgaccggtgctcgatttagtcgagctctcagagagaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttatttttacacgccccaaccaataagagactacttagcttggtccagcaacaaaccaggacagcctcctagtaatgctctatttacgtgggtcgtacgtaacccgggaatagtccggggtccctgaccgtattcagtggcgagcgggtctgggacagtactttcactctacacccatcagcacgcctagcaggctagaaagagtggtgctaagtttatactgtacagtataattattatatttcctacctactaacggtaccgttccgggacctaaagggacccgtaggggtaagaaaactacgaaaacgtacgtggacggtactcg

SEQ ID NO: 330441 - DNA, 625 bp, Homo sapiens
  misc_feature: GZ8MTXP02FG13L.21.52.E08.1.454.CMB.2.raw
  modified_base (322)..(322): a, c, t, g, unknown or other
  misc_feature (322)..(322): n is a, c, g, or t
tcagtcgtcgctcgcacgaccggtgctcgatttagtcgagctctcagagagaaagggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatacaactgcaagtccagccagagttatttttacacgacccccacaataagagctacttagcttggtccagacaacaaaccagacagccctcctgtaatcgctactattacgngggtccgtaccgtaccgggtaatacggtcccggggtcccctagaccgtacgttcgaggtcgggcgacgggccgggtcgttacggggaactaggtactttcgaaccttctaccgaccatacagaccacgcctaggcagggtctaggaagtagtcggtgtaccttagtttaagtcctaggtacaagtactaaattatttaattacgtttcctacctacgtacggtaccgttcggaaccgaaacggggtaccgaaaggggtaacgtaaaactaccgaaaaaccgtcgtacggtaccgcgttaaccg

SEQ ID NO: 330442 - DNA, 651 bp, Homo sapiens
  misc_feature: GZ8MTXP01BHBHZ.4.75.G09.1.454.CMB.2.raw
  modified_base (249)..(249): a, c, t, g, unknown or other
  misc_feature (249)..(249): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttgggggataagtatgttgttggtancagcagaagccaggccagtcccctgtgctggtcattctattatgataccaagcggccctcgagggacctcccgtgacgcgtattcctcgtggcctaccaactcgtagggaacacgacgccactctacgacctatcgaacggccgggacccagggacctaagtgggaattcgggaacgggggtcttacggtaaactttaacgtttaccgtacggttacccgaaggggtccggttagggggtaaccaacgggtaccaacgggaacccgtaacccgttcccccttaaagttccgttaaccggttttcccgggaccgttaccggttaccggggaaaacccgtaaacgggggttccctaccccgggttacccgttaaccggggttaaccaacccggtaaacccccgg

SEQ ID NO: 330443 - DNA, 496 bp, Homo sapiens
  misc_feature: GZ8MTXP01BZ7JH.4.75.G09.1.454.CMB.2.raw
  modified_base (455)..(455): a, c, t, g, unknown or other
  misc_feature (455)..(455): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctcgtggagataagtgggggataagtatgttgtgtatcagcagagccaggccagtcccctgtgctggtcatctattatgataccaagcgccctgagggacctcccgtgacgcgattctctggctaccaactcgtagggaacacacgcccatctgaccatcacggcgggaccagggctagtggatggagggtctagactattactgtcagggcgtgggacagcagcacttccctattcgtctcggcncgttgggaaccaggtccaccggtcttaggtcaacgaacccg

SEQ ID NO: 330444 - DNA, 473 bp, Homo sapiens
  misc_feature: GZ8MTXP01AHWTO.4.75.G09.1.454.CMB.2.raw
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (466)..(466): a, c, t, g, unknown or other
  misc_feature (466)..(466): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtgggggataagtatgttgtggtatcagcagaagccaggccagtcccctgtgctggtcatctattatgataccaagcggccctnagggactccctgagcgattcnctggctccaactctgggaacacagccactctgaccatcagcgggaccaggctatggatgaggggctgactattactgtcaggcgtgggcagcagcacttcctangtctcggcncgttcggaacagtcacgtccaggtcngaacccg

SEQ ID NO: 330445 - DNA, 633 bp, Homo sapiens
  misc_feature: GZ8MTXP01BN4G5.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcatttattggatgatgataagcgctacagcccatctctcgatgaacaggctacaccaatccaccaaacgggaccgaccctacccaaaaaaccagggtacgtaccctttaacaaacttcgaacccaaacaagtacggaaccccttggacggacaacaacgacccaacgtaacttaacttaaccgtgttacggaccaacgaaggacggaacgtaccggggacaacggccgtaacgggttggggtttcgggggtccgttacgggtcgggggacccgttaccgggggttaaccccttcgggggtaacccacccggttcctcccgtcgaccggtcccttaacccgaaccccggg

SEQ ID NO: 330446 - DNA, 530 bp, Homo sapiens
  misc_feature: GZ8MTXP01AME3A.4.75.G09.1.454.CMB.2.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (438)..(438): a, c, t, g, unknown or other
  misc_feature (438)..(438): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcagcccccaggaaggccctggagtggcttgcactcatttattgggatgatgataagcgctacagcccatctctgatgaacnggctacaccntccaaccaaggaccgaccctacccaaaaaccacgggtacggtaccttaacaatcgaaccaacactcggaccctgtggacacagccacatagttacngtgcacagagagtacgggcagcaacggtgggtttggggcttacgtggggccagggacccttggtcaccgtcctctcacgccttccgaacccg

SEQ ID NO: 330447 - DNA, 599 bp, Homo sapiens
  misc_feature: GZ8MTXP01DXZVM.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcagcccccaggaaggccctggagtggcttgcactcatttattgggatgatgataagcgctacagcccatctctgatgaacagctacaccntcaaccaaggaccgaccctaaccgaaaaaccgacgggtacgtacccttaacaatcgaaccaaacagttacggaaccctgtacggaaccacaacgacccaacgtaacttatttaacctgggtacgccaacgaagaacggacgtaacgggggcaacggcgtaacgggttgggggtttcgggggcttacgggtcgggggcccaagggggttaccccttggggtccacccggtctcccgtcgacgtccccttccgaacccgg

SEQ ID NO: 330448 - DNA, 518 bp, Homo sapiens
  misc_feature: GZ8MTXP01C4FE9.4.75.G09.1.454.CMB.2.raw
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (399)..(399): a, c, t, g, unknown or other
  misc_feature (399)..(399): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtgggggataagtatgttgtggtancagnagaagccaggccagtcccctgtgctggtcattctattatgataccaagcgccctnacgggactcccgtgngcgtattctctcggcctccaaacgtcgtacgggaacacacgcctactctagaccatcgagccgggaccagggctaagnggatgagggtctagtacttagttactgtcgaggccgtggacagcagctaccttcctattcgttcgtcggacgcgttcgggaacccaggtccaccgtcgttacggtccgaacgaaccccg

SEQ ID NO: 330449 - DNA, 510 bp, Homo sapiens
  misc_feature: GZ8MTXP01EZCDK.4.75.G09.1.454.CMB.2.raw
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctgatgaacagctacaccntcaccaagacacctacaaaacngtgtctanatgacaanatggaccctgtagacacagccacatatactgtgcacagagatacgggcaggcaacggtggtttggggcttacgtcgggggccaggggaccccttgggtccaccggtctacccgtcacgcccttccgaacccgg

SEQ ID NO: 330450 - DNA, 500 bp, Homo sapiens
  misc_feature: GZ8MTXP01CPUYO.4.75.G09.1.454.CMB.2.raw
  modified_base (248)..(248): a, c, t, g, unknown or other
  misc_feature (248)..(248): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttgggggataagtatgttgtggtancagcagaagccaggccagtcccctgtgctggtcatctattatgataccaagccggaccctcgagggactcccgtagagcgtattctctggcctccaaactcgtagggaacacacgcccactctacgaccatacaggccgggacccagggctagtggatggaggggctgactattacngtcgaggcgtggacagcagcacttcctattgtctcgcncgttcgggaacaggtcacgtcttaggtcncggaaccc

SEQ ID NO: 330451 - DNA, 635 bp, Homo sapiens
  misc_feature: GZ8MTXP01CWRQ1.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtcccgtcgtccccaggacagacagccagcatcagctgctcgtaggagtaagtaaaggttgggggaattaaggtattggtttgttggtatcgagacaaggaaacgccgaaggcccctacggtccccctagtcgcgtggtactattacttaattagtagaactaaccgaacgccgtaccccgtagacgggtaccctcccgtagacgcgtacttctcgtcggcctaccaaacgtccgaagggaaccacgacgccctaactcgtacgaccacgtcgaacggcccgggaaccaggtccgtaagtcggagtcggacggggtctacgtaacttagttacgtgtacgagggtccgagggacacgacaacggtcctaaccgttccttagttccgttccgttcggacgttacggttaccgggaacctacggtccgtacccgttacgaccgggtccaaccggaaccccg

SEQ ID NO: 330452 - DNA, 699 bp, Homo sapiens
  misc_feature: GZ8MTXP01DYP0T.4.75.G09.1.454.CMB.2.raw
  modified_base (390)..(390): a, c, t, g, unknown or other
  misc_feature (390)..(390): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaggccctggagtggcttgcactcatttatggatgatgataagcgctacagcccatctctcgatgaacaggctacaccaactacaaccaaaggaccgaccctaaccaaaaccgaggtacggtaccttaanaaactcgaacccaaacgacttacggggaccccttaggtacggaaccaaccgacgacccaaccgtaaatttaactttaaaccgttggttacggaccaaaccgtaaacggaaaggttaacgtaaccgggggacccgtaaggacccggtaaaccggggtttggggggtttttacggggggacccgtttaaaccggggttccggggggggaacccgaaaccggggggttaaaccccttacgggggttccccaaccccgggtttcccttaccccgtccgaacccgggtccccttaaccccgaaaacccccgggg

SEQ ID NO: 330453 - DNA, 515 bp, Homo sapiens
  misc_feature: GZ8MTXP01DX0Z3.4.75.G09.1.454.CMB.2.raw
  modified_base (338)..(338): a, c, t, g, unknown or other
  misc_feature (338)..(338): n is a, c, g, or t
  modified_base (427)..(427): a, c, t, g, unknown or other
  misc_feature (427)..(427): n is a, c, g, or t
  modified_base (497)..(497): a, c, t, g, unknown or other
  misc_feature (497)..(497): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctgatgaacagctacacntcaccaaaggacgacctaccaaaaacaggtgtaccttacaatgaccaacatcggaaccctgtgacacagccaacatattactgtgcaanagagagtacggcagcgtaaggtggttgggcttacggtcgggaccgacgggaccttggtccaccgtctccncacgtcccttccgaaccg

SEQ ID NO: 330454 - DNA, 526 bp, Homo sapiens
  misc_feature: GZ8MTXP01DDXLQ.4.75.G09.1.454.CMB.2.raw
  modified_base (410)..(410): a, c, t, g, unknown or other
  misc_feature (410)..(410): n is a, c, g, or t
  modified_base (462)..(462): a, c, t, g, unknown or other
  misc_feature (462)..(462): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtgggggataagtatgttgtggtatcagcagaagccaggccacgtcccctgtcgtctggtcatctattatagactaccgaagccggcctcgacgggtacctccctggagtcgtattctcgtggctaccaacgtcgtacgggaacacgacgccaactctacgaccatcgaaggccggaccaggctaagngatgagggctagactatacgtgtcgaggcgtggacagctagctacttcctancgtcgtcggacttcggttcggaacctaacggtccgacccgtccgttaggtccgaacgaaccccg

SEQ ID NO: 330455 - DNA, 558 bp, Homo sapiens
  misc_feature: GZ8MTXP01CB8J4.4.75.G09.1.454.CMB.2.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (501)..(501): a, c, t, g, unknown or other
  misc_feature (501)..(501): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttgggggataagtatgttgtggtatcagcagaagccaggccagtccccngtgctggtcatctattatgataccaagcgcctnagggacctccctgagcgtattctctggcctcccaaacgtcgtaggggaacacacgccctaactctagaccatcgacggccggggaacccagggactaagtgggaatggaggggtctaggtaaccttagttaacctgtccgaagggccggtggggaacaggcacggcctaacttccctattcggttaccttcggacncgttacggggaaccctaaacgggtccacccggtcgttacgggtccaacggaaccccg

SEQ ID NO: 330456 - DNA, 641 bp, Homo sapiens
  misc_feature: GZ8MTXP01DMEOU.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattggatgatgataagcgctacagcccatctctgatgaacaggctacaccntcaaccaaaggaccgaccctaaccaaaaaccacgggtacgtacccttaacaaatcgaaccaaacatacggacccctgtagggaaccaacgacgacccaacgtaattaactttaaccgtgttacggaccaaccgaaggaacgaagttaaccgggggaccaggtccgtaacgggtttgggggttttggggggacccttacgggttacgggggggccccttaacggggggttaaaccccttggggtccccgaacccgggttccttccccgttacgaccggtccccttccccgaaaaccccggg

SEQ ID NO: 330457 - DNA, 510 bp, Homo sapiens
  misc_feature: GZ8MTXP01CFQ19.4.75.G09.1.454.CMB.2.raw
  modified_base (203)..(203): a, c, t, g, unknown or other
  misc_feature (203)..(203): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttcnctgggttctcactcagcactagcggagtgggtgtgggctggatccgtcagcccccaggaaaggccctggagtggcttgcactcatttatgggatgatgataagcgctacagcccatctctgatgaacaggctcaccntcaccaaaggaccgcctaccaaaaaccnggtcgtaccttacaatgaccaanatcggaaccctgtggacacagccacatattacngtncacagagatacgggnagnaacggtggttggggcttacgtgggccagggacccttggcaccgtctcctcacgccttcgaacccg

SEQ ID NO: 330458 - DNA, 539 bp, Homo sapiens
  misc_feature: GZ8MTXP01ES6RJ.4.75.G09.1.454.CMB.2.raw
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcattagtggatgatgataagcgctacagcccatctctgatgaacagctacaccntcaaccaaggacacctacaaaacngtcgtactacaatgaccaanatcgacctgngacacagccanattatactgtgacacgagagacgtacggggcaggcgaacggttgggtttcggggcttacggtgggggcccaacggggttaccccttgggtaaccacccggttcctcccgtcgacgtcccgttcccgaaccccgg

SEQ ID NO: 330459 - DNA, 546 bp, Homo sapiens
  misc_feature: GZ8MTXP01A0AJU.4.75.G09.1.454.CMB.2.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (326)..(326): a, c, t, g, unknown or other
  misc_feature (326)..(326): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataagtggggatagtatgttgtggtancagcagaagccaggccagtcccctgngctggtcatctatatgataccagccgcctgacgggacctcccgtgacgcgtattcncgtcggcctaccaaacgttccgtagggaaccacacgacccactcctacgaccatcgaacggccggggaccccagggctagtggagtgacggggtctaggacttacgtactgtcgaggcggtcggacgagcagcctaccttcccgtattcggtcgttcggcgttccgttacgggaacctacgggtcctacccggtccgttacggtcccgaacggaaccccg

SEQ ID NO: 330460 - DNA, 562 bp, Homo sapiens
  misc_feature: GZ8MTXP01BFP34.4.75.G09.1.454.CMB.2.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (435)..(435): a, c, t, g, unknown or other
  misc_feature (435)..(435): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtgtccgtgtccccaggacagacagccagcatcagctgctctggagtataaagtgggggaataagtatgttgtggtatcagcagaagccaggccagtcccctgtnctggtcatctattangataccgagccgcctgacggctcctgagcgattcnctgctaccatcaggaacacacgaccactcngaccatcgacggccggaccaggactagnggatggaggggtctaggaaccttactaacgtcggtacgaggggtaccggnggggacacgggcacggcctaaccgttccccttaagttccgttcgttaccggcgttaccgggttcgggaaacccaacgggttcccgaaacccggttccgttaacggggtcccaaccggtaacccccgg

SEQ ID NO: 330461 - DNA, 550 bp, Homo sapiens
  misc_feature: GZ8MTXP01ATCWD.4.75.G09.1.454.CMB.2.raw
  modified_base (288)..(288): a, c, t, g, unknown or other
  misc_feature (288)..(288): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataagttgggggataagtatgttgtggtatcagcagagccaggccagtcccctgtgctggtcatctattangatacgagccggcctgacggactcccgtgacgcgtattctcgtcggctccaaacgtctacggggaaaccacgacgccctactctacgacccatccgaacggccgggaacccagggacctagtggagtggacgggggtctaggtacctagttactggtcgacggtcggtcggacagcaggcctaaccttccctagttcgtccgttcggacttcggttacgggaaccaaggtcccaacggtccgttaggtccgaacgaaccccg

SEQ ID NO: 330462 - DNA, 630 bp, Homo sapiens
  misc_feature: GZ8MTXP01BOB56.4.75.G09.1.454.CMB.2.raw
  modified_base (243)..(244): a, c, t, g, unknown or other
  misc_feature (243)..(244): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataagtggggatagtatgttgtgtannagcagagcaggccagtccctgtgctggtcatctattatgataccgaagccgcctgacgggacctcccgtagacgcgtattccgtcgtcggcctaccgaaaccttcggtacggggaaaccacgacgccctactctacgaacccatccgaacgggcccggggaacccagggtacctagtagggaagttgggaacgggggtccttagggtaacttaacgtttacgtcggtaccggagggtacgggtaggggaacccagggcccaacggcctaacccttccccgtaagttccgggttcccgtttaccggggacccgttacggttaccggggaaaccctaacggggttccctaacccggtcgttaaccgggtcccaacccgggaacccccg

SEQ ID NO: 330463 - DNA, 535 bp, Homo sapiens
  misc_feature: GZ8MTXP01BI4HT.4.75.G09.1.454.CMB.2.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (447)..(447): a, c, t, g, unknown or other
  misc_feature (447)..(447): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctgatgaacaggctacaccntcaccaaaggaccgacctaccaaaaccnggtagtaccttaacaatcgaaccaacatcggaccctgnggacacagccacgatattactgtgcacagagatacggggnagcaacggtggtttggaggttcgtaacgtcggggacccgagggaaccccgtgggtccaacccgtctccgttcaacggccctaaccccg

SEQ ID NO: 330464 - DNA, 542 bp, Homo sapiens
  misc_feature: GZ8MTXP01CTJSO.4.75.G09.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (461)..(461): a, c, t, g, unknown or other
  misc_feature (461)..(461): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtgggggataagtntgttgtggtancagcagaagccaggccacgtcccctgtgctggtctatctattatgataccgagccgcctcgacgggacctcccgtagacgtcgtacttctcgtcggcctacccaaactcgtagggaaccacgacgccctactctacgaccactaccgaggaccgggaccagggctagtgagtggacgggtctgtaactattacgtgcgtaggcggtggacagcngcctaccttcctagttcgtacgttcgacgttcgttcgggaacctaacggtcctaccgtccgttacggtccaacgaaccccg

SEQ ID NO: 330465 - DNA, 518 bp, Homo sapiens
  misc_feature: GZ8MTXP01EZ6GI.4.75.G09.1.454.CMB.2.raw
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccccaggaaaggccctggagtggcttgcactcatttattgggatgatgataagcgctacagcccatctctgatgaacaggcctacaccntcaaccaaaggaccgacctaccaaaacnggtagtccttanaatgaccaanatggaccctgcgacacagccacatattactgtcgcacagagatacgggcagcaacggtgggtttgggcttacgtggggccagggacccttgggtcaccgtctcctcacgtcccttccgaacccg

SEQ ID NO: 330466 - DNA, 522 bp, Homo sapiens
  misc_feature: GZ8MTXP01B9VE7.4.75.G09.1.454.CMB.2.raw
  modified_base (217)..(217): a, c, t, g, unknown or other
  misc_feature (217)..(217): n is a, c, g, or t
  modified_base (317)..(317): a, c, t, g, unknown or other
  misc_feature (317)..(317): n is a, c, g, or t
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccatggcctcctatgagctgactcagccaccctcagtgtccgtgtccccaggacagacagccagcatcagctgctctgganataagtggggatagtatgttgtggatcagcagaagccaggccagtcccctgtgcgtggtcatctattatgactaccgaagccggcctcgacggactccgngacgcgaacttctcgtggcctaccactcgtacgggaacacgacgccactctcgaccataccgacggaccgggacccaggcctagtagggactggggacggtctacggtaacttagttaccgtgtacgaggcgtagggaccagcaacgcncctccttagtcgtcttcggcacgtcgggacaagtccnccgttctaacggcaaccgg

SEQ ID NO: 330467 - DNA, 522 bp, Homo sapiens
  misc_feature: GZ8MTXP01DDBYE.4.75.G09.1.454.CMB.2.raw
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (447)..(447): a, c, t, g, unknown or other
  misc_feature (447)..(447): n is a, c, g, or t
tcagagcactgtagcacgaccggtgctcgatttagtatagacatcaggggctgggcctcaggaagcagcatcggaggtgcctcagccatggcatggatccctctcttcctcggcgtgcttgcttactgcacaggatccgtggcctcctatgagctgactcagccaccctcagtgtccgtgtccccaggacagacagccagcatcagctgctctgganataagttggggatagtatgttgtgatcagcagagccaggccagtcccctgtgctggtcatctattangactacgacgcggcctcgacggactccgtgacgcgtaacttctcgtcgcctaccaacgtcgtacgggaacacgacgtcccactcacgaccatcgacggccgggacccaggctagtaggatggggagtctagtacttagttacgtgtacgagggtcgtgggacngctaagcttactcccgttagtcgtcgttcggcacgtcgggaacctaacggtccaccgttccgtggttccgaaccg

SEQ ID NO: 330468 - DNA, 600 bp, Homo sapiens
  misc_feature: GZ8MTXP01D10W6.4.75.G09.1.454.CMB.2.raw
  modified_base (463)..(463): a, c, t, g, unknown or other
  misc_feature (463)..(463): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcagcccccaggaaaggccctggagtggcttgcactcatttatggatgatgataagcgctacagcccatctctgatagaacaggctaccaccaatacaacccaaacggaccaccctaacccgaaaaaccgagggtcggtacccttaacaaactacgaacccaaacacgttacgggaaccctggtacggaacaacacgaccactaatactttacgngtcgacacagaacgagtacggggcaggcgtaacggttgggttcgggggcttaacggtcgggggacccgttaacggggaacccgttcggtcccgacccggttcctcccgtacgacgtccccgttccccgaaacccggg

SEQ ID NO: 330469 - DNA, 686 bp, Homo sapiens
  misc_feature: GZ8MTXP01AOMPD.4.75.G09.1.454.CMB.2.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgatagcgctacagccatctctcgatagaacnggctacaccntcaaccaaggaccgacctaccaaaaaccgnggtacggtaccttaacaatacgaacccaacgacgtacggacccctaggtacggaacaacgacgaccccaacgtacttaatttaaccttggtacgaccaacccgaaggtaaacggaacgttaaccggggggaccaacgggtccggtaaacccggggtttgggggtttttacggggggacccttaaccggggttaccgggggggtaccccgaaaccggggggttaaacccccttccgggggttaaccccgtaaccccgggtttccttccccgttacccgaacccgggtcccctttaacccccggaaaacccccgggg

SEQ ID NO: 330470 - DNA, 538 bp, Homo sapiens
  misc_feature: GZ8MTXP01EZAP2.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttatggatgatgataagcgctacagcccatctctgatgaacaggctacaccntcaccaaggacgacctaccaaaaccagggtcgtaccttacaatgaaccaacacgtcggaccctgtacggacacagcccacgatattactgtcgcacagagatacgggcagcgtaaggtgggtttgggggcttaacggtcgggggccacggggacccttgggtccaccggtctccctcgacgcccttccgaaccccgg

SEQ ID NO: 330471 - DNA, 519 bp, Homo sapiens
  misc_feature: GZ8MTXP01CZR4C.4.75.G09.1.454.CMB.2.raw
  modified_base (250)..(250): a, c, t, g, unknown or other
  misc_feature (250)..(250): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttgggggaataagtatgtttgtggtancagcagaagccaggccagtcccctgtgctggtcatctattatgataccaagccgccctgacgggtactcccgtgagtcgtatttcctcgtcggcctacccgaaactcgtacggggaacacacgcccactctgaccatcgagccgggaccaggctagngatgaggctgactatactgtcaggcgtggacagcngcacttcctattcgtacgttcgacgttcgttcgggaacctaagggtccaaccggtccgttagtccgaacgaaccccg

SEQ ID NO: 330472 - DNA, 597 bp, Homo sapiens
  misc_feature: GZ8MTXP01BASNP.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaaggcccgtggagtggcttgcactcatttagtggatgatgataagcgctacagcccatctctcgatgaacaggctacaccaatccaaccgaaaggaccgaccctaaccaaaaaccagggtcgtaccttaacaatcgaaccaacacgtcggacccctggtacggaccaacgtacgaccccaacgtaattaactttacctggtcgaccaacgaaggaacgagtaccggggacacgcgtaacgggttgggtttcgggggcttacgggcgggggacccttacgggggaccccttggggcctacccgtccgccttcacggtccccttaaccgaaccccgg

SEQ ID NO: 330473 - DNA, 663 bp, Homo sapiens
  misc_feature: GZ8MTXP01DUTOH.4.75.G09.1.454.CMB.2.raw
  modified_base (465)..(465): a, c, t, g, unknown or other
  misc_feature (465)..(465): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccccaggaaaggccctggagtggcttgcactcattagtggatgatgataagcgctacacgcccatctctgatgaacaggctacaccaataccaaccgaaacggaccaccctaacccgaaaaaccgacggttacggtaccttaacaaagtacgaaacccaaactaacgttcggaaccccttagggacgaaccaaccgaacgacccctaanaacgttaactttaaacgtcgtaggaaccaaccgaaaggaagtaacgtaccggggaccaacggtcgtaaccgggtttggggttttcgggggccttaacgggtccggggggacccgaaccggggttaaccccggttcggtccccgtaaccccggttcccgttcccctaccgaccgtcccccgttcccgaaaacccccggg

SEQ ID NO: 330474 - DNA, 668 bp, Homo sapiens
  misc_feature: GZ8MTXP01DO13A.4.75.G09.1.454.CMB.2.raw
  modified_base (554)..(554): a, c, t, g, unknown or other
  misc_feature (554)..(554): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctcttgggttctcactcagcactagcggaggtggggtgtgggctggatccgtcacgcccccaggaaacggccgtggagtggcttgcactctatttagtggatgatgataagcgctacagcccatctctgatagaacaggcctaaccaccaactaccaaacccgaaacgggaacccgacccctaaacccgaaaaaacccgtacgggttaccggttaccctttaaacgaaacttaccggaaaccctaaacgaacgttaccgggtaaccccgtaggtaaccgggaaaccaaccgtaacgacccctaaacgtaactttaacgtttacctaggtacgacaacgagaagacgtacgggnaacggcgtaacgggttggggtttcggggacttacgggtcgggggaccgacgggggttaacccttcgggtcccgtacccgtcctcccgtacgacgtccccttaaccgaaccccgg

SEQ ID NO: 330475 - DNA, 632 bp, Homo sapiens
  misc_feature: GZ8MTXP01ETE0X.4.75.G09.1.454.CMB.2.raw
  modified_base (349)..(349): a, c, t, g, unknown or other
  misc_feature (349)..(349): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgcccccaggaaacggccctggagtggcttgcactctatttagtggatgatagatagcgactacacgcccatctctgatagaacagctaacaaccntaccaaccgaaacggaccgaccctaaccaaaaaccgtagggtacgttacccttaacaatacgaacccaaacgtacgtacggacccctggtacggaaccaacgacgacccaacgtaactttaacttaaccgtgtacgacaacgaaggaagagtacggggcaggccgtaagggttgggtttaggggccttacgggtcggggacccgaacgggggttaccccgttgggtaaccctacccggttcccttcccgaccgaccgtccccgttaacccgtaaaccccgggg

SEQ ID NO: 330476 - DNA, 555 bp, Homo sapiens
  misc_feature: GZ8MTXP01D0LD3.4.75.G09.1.454.CMB.2.raw
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgacccccaggaaaggccctggagtggcttgcactcatttagtggatgatgataagcgctacagcccatctctgatagacagctacacntcaaccgaagaccgacctacaaaaccgagtcgtaccttaacaaatcgaaccaaacagtcggaccctgngaacacganccacaattattactgtgccanagaagatacgggcagcgtaacggttggggttttggggctttaacgcgggggccttaacggggaaccccttgggtcccaacccggttcttcccgcacgcccttaacccgaaccccgg

SEQ ID NO: 330477 - DNA, 539 bp, Homo sapiens
  misc_feature: GZ8MTXP01CS79Z.4.75.G09.1.454.CMB.2.raw
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccaggaaacggccctggagtggcttgcactctatttagtggatgatgataagcgctacacgccatctctgatgacagctacaccntcaccaagacgcctacaaaacnggtcgtactacaatcgaccaacatcggaaccctggtcggacacacgccaacattacttacngtgcacgagagagtaacgggnacggcaacggttgggtttcggggcttaacggtcgggggccgacgggacccttgggtccacccggttctcctcgacgcccttcccgaacccgg

SEQ ID NO: 330478 - DNA, 519 bp, Homo sapiens
  misc_feature: GZ8MTXP01BDFKJ.4.75.G09.1.454.CMB.2.raw
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctcgatgaacagctcaccaatcaacccaaggaccgacctaccaaaaaccngggtacggtccttaacaatcgaaccaacactggaccctgtaggacacagccanatatacngtgcacagagatacgggcagcaacgtggttggggcttacgtggggccagggacccttgggtccacgtctcctcacgccttcgaacccg

SEQ ID NO: 330479 - DNA, 514 bp, Homo sapiens
  misc_feature: GZ8MTXP01BKV5K.4.75.G09.1.454.CMB.2.raw
  modified_base (423)..(423): a, c, t, g, unknown or other
  misc_feature (423)..(423): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataatgggggataagtatgttgtggtatcagcagaagccaggccagtcccctgtgctggtcatctattatgataccagcgcctcgagggactccctgacgcgattctctggctccaactcgtagggaacacacgccactctacgaccatcaggccgggacccagggctagtggaagtgaggggctaggactagttacgtgtaccgngggtcgtgggacagcaaggcaacttccctagttcgtcttcggcgcgttgggaacctaggtccaccgtccgttaggtccgaacgaacccccg

SEQ ID NO: 330480 - DNA, 621 bp, Homo sapiens
  misc_feature: GZ8MTXP01DBKH9.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacacgccatctctgatagaacaggctaccaccntacaaccaaaggaccgaccctaccaaaaaccacgggtcggttacccttaacaatacggaaccctaaacacgttcgggaacccttggtacggaaccaacgacgacccaacgaacttaattaaacctggtcgaccaacgagaagataacggggcaggcgaacggttggggtttcgggggccttaacgggtcgggggacccgaacgggggttaaccccgttgggtaacccgtacccggttcctacccgtccaaccggtccccttaaccgaaaccccggg

SEQ ID NO: 330481 - DNA, 673 bp, Homo sapiens
  misc_feature: GZ8MTXP01D11W2.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcagcccccaggaaacggccctggagtggcttgcactcatttatggatgatgataagcgctacacgcccatctctacgatagaacaggctaccaccntaccaaccgaaacgggaccgacccctaaccaaaaaccgtagggtacgtacccttaacgaatacgaaccaaacgacgtacgggacccctaggtacgggaaccaaccgaagacccctaacgtaactttaacttaacccgtggttacgaacccaacgaaggaaggtaacgttaccggggacaaggtcccggtaacgggtttgggggtttacgggggacccttaaacgggtccggggggtaacccgttaacgggggttaaaccccttcgggggtccctaaccccgggttcctcccgttaccgaccgtccccgttaacccggaaacccccggg

SEQ ID NO: 330482 - DNA, 589 bp, Homo sapiens
  misc_feature: GZ8MTXP01BDW6Q.4.75.G09.1.454.CMB.2.raw
  modified_base (411)..(411): a, c, t, g, unknown or other
  misc_feature (411)..(411): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctggttctcactcagcactagcggagtgggtgtgggctggatccgtcacgcccccgaggaacggcctggagtggcttgctactctatttagtggatgatagatagcgactacacgccatctctgatagaacacgctaacaccaatccaaccgaacgggaccacctaaccaaaacgtcggtacgttaccttaacaatacgaaccaanacgtaccggacccttaggtacggaacaacgacgaccctaagtattaactttacgtgtcgacacgaaggagtacgtacggggacacggcgtaacggttggggtttcgggcgttaacggtcgggggaccgacgggaccgttcggtccgtaccgtcctcctcaccgtcccttccgaaccgg

SEQ ID NO: 330483 - DNA, 584 bp, Homo sapiens
  misc_feature: GZ8MTXP01DGHFF.4.75.G09.1.454.CMB.2.raw
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (473)..(473): a, c, t, g, unknown or other
  misc_feature (473)..(473): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggcctggagtggcttgcactcatttattgggatgatgataagcgactacagcccatctctgatagaacngctacaccntcaaccgaaacggaccgaccctaaccaaaaaccgtagggtacggttaccttaacaactacgaaacccaaacgaagtacggaacccctgtacggaacacacgacccaacgtaattagttaactcgtgacanacgagacgtaacgggcagcgtaacggttgggtttggggcttacggtcggggcccaacgggttacccgttggtccaccggtcctccgtcacgtccccgttaaccgaacccgg

SEQ ID NO: 330484 - DNA, 707 bp, Homo sapiens
  misc_feature: GZ8MTXP01AZXEX.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctgatagaacgacgctaccaccaactaccaacccgaaacgggacccgacccctaacccgaaaaaccgtacgggtaccggttacccttaaacgaactaccggaaacccaaacgtacgtaccggaccccgttaggtaccggaacaaccgacgacccaacgtaacttaacgtttaaccgtaggtacgacccgaacgaaggaaacggtaacggttaaccgggggactacgggtacccggtaacggggtttcgggggttttacgggggaccgtttaaaccggggtcccggggggaacccgttaaacccgggggttaccccgttcggggttaaccccgtacccggttcccttacccgtaccgacccgtcccccgttaacccgaaacccccggg

SEQ ID NO: 330485 - DNA, 532 bp, Homo sapiens
  misc_feature: GZ8MTXP01AB9IE.4.75.G09.1.454.CMB.2.raw
  modified_base (218)..(218): a, c, t, g, unknown or other
  misc_feature (218)..(218): n is a, c, g, or t
  modified_base (292)..(292): a, c, t, g, unknown or other
  misc_feature (292)..(292): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggganataaagttgggggataagtatgtttgtggtatcagcagaagccaggccagtcccctgtgctggtcatctattangataccagcgcctgagggacctccctgacgcgtattccgtcgtggcctaccaactcgtacggggaacacacgcccaactctcgaccatccgaggccgggacccagggcctaagtggatggagggctagtaacttagttactggtcaagggccggtgggacagcaagctacttccctagttcgtccgttcgcgttacgcgggaacctaggtccaccggtccttacgggcaaccgaaccccg

SEQ ID NO: 330486 - DNA, 682 bp, Homo sapiens
  misc_feature: GZ8MTXP01CLZAR.4.75.G09.1.454.CMB.2.raw
  modified_base (352)..(352): a, c, t, g, unknown or other
  misc_feature (352)..(352): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggccctggagtggcttgcactctatttagttgggatgatagataagcgctacagcccatctctcgatagaacaggctaccaaccctnaccaaccgaaacgggacccgacccctaacccaaaaaaccgtacgggtacggttacccttaacaaactacgaacccaaacacgttacggaccccgttaggtacggaaccaaccacgaccccaacgtaacttaactttaaccgtgttacggacaaccgagaaacggtacgtaccgggacacggtccgtaaacggggtttgggttttcgggggaccgttaaccgggttaccgggggacccgttaaaccgggggttaaaccccgttcggggttccccgtaaacccgggttccttccccggttaccaccggtccccttaacccgaaacccccggg

SEQ ID NO: 330487 - DNA, 590 bp, Homo sapiens
  misc_feature: GZ8MTXP01CRBQB.4.75.G09.1.454.CMB.2.raw
  modified_base (344)..(344): a, c, t, g, unknown or other
  misc_feature (344)..(344): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgcccccgaggaaaggcccgtggagtggcttgcactctatttagttggatgatgataagcgctacagccatctctgatagacagctacacntacaccaaacggacgacctaaccaaaaccgaggtacgtaccttaacaatacgaaccaacatacggacccttggacgaacacacgaccaacgattaattactgtacgacaacgagaagacgtacgggacagcgtcgggttggggtttcgggggccttacgggtcgggggaccgaaccgggggttaaccccttgggtaaccctacccggttcctcccgtcgaccggtccccgttcccgaaaccccggg

SEQ ID NO: 330488 - DNA, 588 bp, Homo sapiens
  misc_feature: GZ8MTXP01CBPDX.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactctatttagttggatgatgataagcgctacacgcccatctctgatagaacacggcctaacaccaataccaacccgaaacggaccgaccctaaccgaaaaaccgtagggttacgtacccttaacaactacgaaccaacgatcggacctgtacggacacacgaccacgaacttacttactgtcgcacgagagagtacgggcacgcgtaacggtgggtttcggggacttacggtcggggcccgacggggttaccccgttgggtcccacccggttctcccgtacgaccgtcccgttcccgaacccgg

SEQ ID NO: 330489 - DNA, 609 bp, Homo sapiens
  misc_feature: GZ8MTXP01CPAMH.4.75.G09.1.454.CMB.2.raw
  modified_base (350)..(350): a, c, t, g, unknown or other
  misc_feature (350)..(350): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (456)..(456): a, c, t, g, unknown or other
  misc_feature (456)..(456): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggactccgtcacgccccccgaggaaacggccctggagtggcttgcactcatttagtggatgatgataagcgactacagcccatctctcgatagaacaggctaacaccntaccaaccaaaggaccacctaacaaaaccaggtcgtacctaanaactgaaccaaantacggaccctggtacggaacaccaagacccaacgtaattactttaaccgngtacgacacgaaggtacgacgtaccgggacacggtcggtaacgggttcggggttcgggaccgttacggggtacggggacccgttaacggggttacccgttcgggtccctacccgttcccgtccgtccgacccgtccccgttaacccgaacccg

SEQ ID NO: 330490 - DNA, 696 bp, Homo sapiens
  misc_feature: GZ8MTXP01CEULR.4.75.G09.1.454.CMB.2.raw
  modified_base (317)..(317): a, c, t, g, unknown or other
  misc_feature (317)..(317): n is a, c, g, or t
  modified_base (682)..(682): a, c, t, g, unknown or other
  misc_feature (682)..(682): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtccagatcaccttgaaggagtctggtcctacgctggtacgaaacccacacacgaccctcacgctcgacctgcctaccttctcgtggttctcactcagcactagcggaggtgggtgtgggctggactccgtcacgcccccgaaggaacggccgtggagtgcttgcacgtctagtttagtggatgagtgtanaagcgactacacgccatcctagtacgatagaaacgacggtacctaaccaacctaactacccgaaaccgaaaccgggacccctaacccctaaacccgaaaaaaccgtacgggttaccgttacccttaaacaacgttacgaaaaccctaacgaacgtacccgggtaacccttaggaccggaaacaacgaaccgtacccaagtaactttaacttaaccgtgacgacaaccgaaggttaacgtacgtaaccggggacacggtacggtaaccgggtttggggtttcggggaccgttaccgggtcgggggacccgttaacggggacccgttcggttaaccgacccggttccttcccggaccacggtccccncccgtaaacccggg

SEQ ID NO: 330491 - DNA, 587 bp, Homo sapiens
  misc_feature: GZ8MTXP01CPCHH.4.75.G09.1.454.CMB.2.raw
  modified_base (396)..(396): a, c, t, g, unknown or other
  misc_feature (396)..(396): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttatctgggttctcactcagcactagcggagtgggtgtgggctggatccgtcagccccaggaaaggccctggagtggcttgcactcatttatggatgatgataagcgctacagcccatctctgatagaacaggctaacaccaactacaacccaaagggaccgaccctaaccaaaaaccagggttacgtacccttaanaaactcgaaccaaacagtacgggaccctggtacggacacacgccaataattaattactgtacgacgacaagaacgaagtaccgggacaggcgtaacgggttggggttcggggacttacgggtacgggggccgaacggggacccttgggtcccacccggtctcctcgaccgtcccgttaaccgaaccccggg

SEQ ID NO: 330492 - DNA, 624 bp, Homo sapiens
  misc_feature: GZ8MTXP01AQYDA.4.75.G09.1.454.CMB.2.raw
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgatagcgctacagccatctctgatgaacaggctacaccntacaccaaggaccgacctaccaaaaaccngggtacggttacccttaacaaacgtcgaaccaaacagtcgggacccctaggtcggaacaacgacgtacccacgacttaagttacctaggtcgacaacgagaaggaacgttaccgggggacaacgggcctaacgggttgggttttacgggggaccttaacgggttcggggggacccaacgggggttaacccccttgggggttaacccaccccgggttccttcccgtccgaaccggtccccttccccgaaaccccgggg

SEQ ID NO: 330493 - DNA, 531 bp, Homo sapiens
  misc_feature: GZ8MTXP01CUT62.4.75.G09.1.454.CMB.2.raw
  modified_base (445)..(445): a, c, t, g, unknown or other
  misc_feature (445)..(445): n is a, c, g, or t
  modified_base (468)..(468): a, c, t, g, unknown or other
  misc_feature (468)..(468): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaacggcctggacgtggcttgcactcatttatggatgatgataagcgctacagcccatctctgactagacaggctacacccaatcaaccaaaggaccgacctaacccaaaaaccaggtacggtaccttaacaatcgaaccaaccatacgggaccctgtacggacacacgccaacactattacngtgcacagacgatacgggcagcnggtggttgggcttacgtgggccagggaccttcggtcaccgtctcctcacgtccttccgaaccg

SEQ ID NO: 330494 - DNA, 627 bp, Homo sapiens
  misc_feature: GZ8MTXP01DA7NH.4.75.G09.1.454.CMB.2.raw
  modified_base (347)..(347): a, c, t, g, unknown or other
  misc_feature (347)..(347): n is a, c, g, or t
  modified_base (415)..(415): a, c, t, g, unknown or other
  misc_feature (415)..(415): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcacgcccccaggaaacggcccgtggagtggcttgcactcatttagttggatgatgataagcgctacagcccatctctgatgaacgaggctacaccntaccaaccgaaacggaccgaccctacccaaaaaccgaggttacggtaccttaacaaatcgaaccaaanagtcggaccctgacggacacagacccacgtattacttaacgtgtacgacacgagagacgtacggggcaacggcgtaacgggttcggggtttagggggaccgttaaaccgggtcggggggtaccccgaaccgggggttaccccgttacgggggttcccaaccccggttcccggttaccctccgaccggtcccccttaacccgaaacccccggg

SEQ ID NO: 330495 - DNA, 632 bp, Homo sapiens
  misc_feature: GZ8MTXP01BQ7J6.4.75.G09.1.454.CMB.2.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttagtggatgatagataagcgctacagcccatctctgatgaacnggcctacaccntcaaccaacgggaccacctaaccaaaaaccgacgggttcggtaccttaacaatcgaaaccaacgacgtcggaaccctggtacggaacaacacgtacccaacgtaacttaactttaaccgtgttacgaccaaccgaggtaaacgagttaccgggggactaacggccggtaaccgggtttgggggtttcgggggaccgttaacgggtcgggggacccgaacggggttaccccgttcgggtccccgtacccggtcctccctacgaccggtccccttcccgaaaccccggg

SEQ ID NO: 330496 - DNA, 668 bp, Homo sapiens
  misc_feature: GZ8MTXP01EOMNI.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctcgatgaacaggctacaccaatcaaccaaggaccgacctaccaaaaccaggtacggtaccttaacaatcgaacccaaacacgttacgggacccctaggtacggaaccaaccgaacgcccaaacgtaattaacgtttaacctggttacgaccaacgaaggtaaggaacgttaaccgggggactacgggaccgtaaccgggggtttggggttttacggggggcccttttaaaccgggtcggggggtaccccgaaacggggggttaaaccccctttcgggggtaaccccgtaaccccgggttcccttccccgtaccgaaccgggtcccccttaacccgaaaacccccggg

SEQ ID NO: 330497 - DNA, 511 bp, Homo sapiens
  misc_feature: GZ8MTXP01DXPZI.4.75.G09.1.454.CMB.2.raw
  modified_base (340)..(340): a, c, t, g, unknown or other
  misc_feature (340)..(340): n is a, c, g, or t
  modified_base (415)..(415): a, c, t, g, unknown or other
  misc_feature (415)..(415): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctgatgaacaggctcaccntcaccaaacggacgcctaccaaaaaccaggtggtaccttacaatgaccaacatggaccctgtggacacagccaanatattactgtgcacagagatacgggcagcaacggtggttgggcttcgtgggggccagggacccgttggtcaccgtctcctcacgcccttcaacccg

SEQ ID NO: 330498 - DNA, 611 bp, Homo sapiens
  misc_feature: GZ8MTXP01DKS7R.4.75.G09.1.454.CMB.2.raw
  modified_base (341)..(341): a, c, t, g, unknown or other
  misc_feature (341)..(341): n is a, c, g, or t
  modified_base (581)..(581): a, c, t, g, unknown or other
  misc_feature (581)..(581): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcatttatgggatgatgataagcgctacagcccatctctgatagaacaggctacaccntcaaaccaagggaccgaccctaaccaaaaaccaggtcggtaccttaacaaatcgaacccaaacatcggaacccctaggtacggaaccaacaacgacccaacgtaattaactttaacctggtagacaacaggaagagtaaccgggcacggcgtaacgggttgggtttcgggggaccttacggtcgggggcccaaacgggggttaaccccttcggggtaaccctacccgggtccttaccccncgaccgtccccttaacccgtaaaccccggg

SEQ ID NO: 330499 - DNA, 715 bp, Homo sapiens
  misc_feature: GZ8MTXP01AP3CR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtggggtgtgggctggatccgtcacgcccccaggaaaggccctggagtggcttgcactcatttattggatgatgatagcgctacagccatctctgatgaacaggctacaccaatccaaccgaacggaccgaccctaacccgaaaaaaccgagggttacggttaccctttaaacaaacttacggaacccaaacacgtacgggaacccctaggtacgggaaaccaaccgacgacccaacgtaacttaacgttttaacccgtaggttcggaccaaccgaaaggaaacggtaacggttaacccgggggacaacgggtccggtaaacggggtttcgggggttttacggggggtacccgttaccggggttaccggggggaccccggttaaaccggggggttaacccccggttagggttaaccccgaaacccgggttcccttaaccccgttcccgaccgggtaacccccttaaccccggaaaacccccgggg

SEQ ID NO: 330500 - DNA, 692 bp, Homo sapiens
  misc_feature: GZ8MTXP01EMG3F.4.75.G09.1.454.CMB.2.raw
  modified_base (309)..(309): a, c, t, g, unknown or other
  misc_feature (309)..(309): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatggatgatgatagcgntacagcccatctctgatgaacaggctaacacaactaccaaccgaaacggaccgaccctaacccgaaaaacgtcgggtacggtacccttaacaaacgtcgaaacccaaactacgttacgggaaccccttaggacggaaccaacgaacgacccaaacgtaactttaactttaaccgtcggttacgaccaaccgaaggaacggtaaccgttaaccgggggacacggtcccgtaaccggggtttggggttttacggggggaccctttaaccgggcggggggttaaccccgaacggggggttaacccccgttcggggttaaccccgtaacccggttccctttaccccgaccgttaacccgggtccccttaaccccggtaaaccccggg

SEQ ID NO: 330501 - DNA, 748 bp, Homo sapiens
  misc_feature: GZ8MTXP01ESQB9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaaggccctggagtggcttgcactcatttatgggatgatgataagcgctacagccatctctgatagaacaggcctacaccaataccaaccgaaacggaccgaccctaacccgaaaaaccgtagggttacggttaccctttaaacaaacggttacgaaacccaaacgtaacgttacccggggtaaccccgtttagggacgggaaacccaaccggtaacgaacccctaaacggtaaactttaaacttttaacccgttgggttacggaccccaaacgaacggaaaaggggtacgttaaccggggggactaacgggacccggttaaaccgggggtttgggggttttaccggggggaccgtttaaccggggtacggggggaccccgttaaaccggggggttaaacccccgttcgggggtttaacccgaaccccgggttcccttaccccgttccgaccgggtaacccccttaaccccgtaaaacccccggggg

SEQ ID NO: 330502 - DNA, 646 bp, Homo sapiens
  misc_feature: GZ8MTXP01CNZ97.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcactagcgggagtggggtgtgggctggatccgtcacgccccaggaaacggcctggagtggcttgctactctatttagtggatgatgataagcgctacacgcccatctctacgatagaacgaggcctaacaccaactaccaaacccgaaacggaccgaccctaaacccgaaaaaccgacgggttaccgttaccttaacaaagtacgaaacccaaacgacgtacggaacccctggtacggaaccaacgacgaccctaagtaacttaagttaacctggtacgacaaccgaggaaacgtacgtaccggggacaacggtccgtaacgggttggggttcgggggtaccttacgggtcgggggacccaacggggttacccttcgggtccctaccggtcctacccgttcaccgtcccgttaacccgaacccggg

SEQ ID NO: 330503 - DNA, 566 bp, Homo sapiens
  misc_feature: GZ8MTXP01ERK23.4.75.G09.1.454.CMB.2.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgccaccttctcgtggttctcactcagcacgtagcggaggtgggtgtgggctggactccgtcacgaccccgaggaaacggccgtggagtgcttgctactntatttagtggatgatagaataacggcactacacgcccatctctagatagaacgngcctaacaccaanaccaaaccgaacggaccaccctaaaccaaaacgtacggtacgtacctaanaagacgaaccaagtaacgtcgaccgtgagaacacacncctaagacttatactgananagagagagtacgagcgngtcggtggttcggtcggttacggtacggacggacggttccgttcgtccgtccgtcctctccgaccgtccgccgaaccg

SEQ ID NO: 330504 - DNA, 513 bp, Homo sapiens
  misc_feature: GZ8MTXP01CCV0F.4.75.G09.1.454.CMB.2.raw
  modified_base (465)..(465): a, c, t, g, unknown or other
  misc_feature (465)..(465): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcagctgctctggagataaagttgggggataagtatgtttgtggtatcagcagaagccaggccagtcccctgtgctggtcatctatatgatacagcgcctgaggactccctgacgcgattcctctggctaccaactctacgggaacacagcccactctcgaccatcgacggccgggaccagggcctagtggatggagggctagacttagtactgtcgaggcgtagggacacgcagccaacttcccgtattcgtacttcggcncgttcgggaacctaggtccaccgtcgttaacggtccgaacgaaccccg

SEQ ID NO: 330505 - DNA, 510 bp, Homo sapiens
  misc_feature: GZ8MTXP01BYZ13.4.75.G09.1.454.CMB.2.raw
  modified_base (217)..(217): a, c, t, g, unknown or other
  misc_feature (217)..(217): n is a, c, g, or t
  modified_base (247)..(248): a, c, t, g, unknown or other
  misc_feature (247)..(248): n is a, c, g, or t
  modified_base (324)..(324): a, c, t, g, unknown or other
  misc_feature (324)..(324): n is a, c, g, or t
  modified_base (421)..(421): a, c, t, g, unknown or other
  misc_feature (421)..(421): n is a, c, g, or t
  modified_base (467)..(467): a, c, t, g, unknown or other
  misc_feature (467)..(467): n is a, c, g, or t
  modified_base (501)..(501): a, c, t, g, unknown or other
  misc_feature (501)..(501): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataaagtgggggataagtatgttgtggtannagcagaagccaggccagtcccctgtgctggtcatctattatgataccagcgcctcgaggactccctgagcgattcnctggctacccaactcgtagggaacaccgagccctactctacgaccatcaacggccgggacccagggctagtggatggaggggctaggactattacgngtcgaggcgtgggaccaggtcagccacgttccctattgtcttcgcncgttcgggaaccagggtcaccggtcttaggtccncgaaccccg

SEQ ID NO: 330506 - DNA, 574 bp, Homo sapiens
  misc_feature: GZ8MTXP01D59H9.4.75.G09.1.454.CMB.2.raw
  modified_base (405)..(405): a, c, t, g, unknown or other
  misc_feature (405)..(405): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgccccaggaagcctggagtgctgcactctatttagttgggatgatagataagcgactacagcccatctctgactagaacaggctaacaccaatacaaccaaaggaccgacctaaccaaaaacgacgtacgtaccttaacaatgaaccaaanagtcggaaccctgacggaacacaacgaccaacgtaattaattacgtagagaccaacgagaagacgtacggggacagcgtaacgggtggggttcgggggcttaacgggcgggggacccacggggaacccttgggtcccaccgtcctcctcacggcccttccgaaacccgg

SEQ ID NO: 330507 - DNA, 753 bp, Homo sapiens
  misc_feature: GZ8MTXP01D25Z7.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccccgaggaaacggcccgtggagtggcttgctactctatttagtggatgatgataagcgactacacgcccatctctgatagaacacgcctaaccaaccaactaccaaacccgaaacggaccccgtaccccgtaaaccccgaaaaaaccgtacgggttaccgttaaccctttaaacgaaacgttaccggaaacccctaaaaccgtaacggttaccgggtaaacccccgtttagggaacgggaaaccccaaccgtaaaccgacccctaaaccgtaaagtttaactttaaccgttacgggtacacccgaaaccgaaggaaacggtaccggttaaacggggaccaacgggtacccgtaacggggtttcgggggttttcgggggaccgtttaccgggttacgggggaccccggttaaacgggggttaccccgttacggggttaacccctacccggttcccttcccgtaccgaccgtaaccccgttaaccccgaaacccgggg

SEQ ID NO: 330508 - DNA, 591 bp, Homo sapiens
  misc_feature: GZ8MTXP01BYBE1.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttagtgggatgatgataagcgctacacgccatctctgatgaacaggctaccaccntaccaaaccgaacggaccgaccctaaccgaaaaaccgacgggttacgtaccttaacaagtcgaaccaaacagtcggaccctggtacggaacaccgacgacccaacgtattaacttaacctggtacgacaacgagagagtacggggacagcgtaacgggttgggtttcggggcgttacggcgggggtaccgacggggttacccttggtcccacccgtctccctcgacgtcccgttcccgaacccggg

SEQ ID NO: 330509 - DNA, 691 bp, Homo sapiens
  misc_feature: GZ8MTXP01DZ7Y3.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagacccctcacgctgacctgcaccttctctgggttctcactcagcactagcggaggtgggtgtgggctggactccgtcacgaccccgaggaaacggcccgtggagtggcttgctactctagtttagtggatgatgataagcactacacgccctatctctgactagaacgacgcctaaccaaccaactaccgaaccgaaaccggaccaccctaaccgaaaaccgtcggtacgtacctaacaacgtacgaaccaacgacgtacggtaccgtggacggaaccaacgacgacccctaagtaactttagttaaccgttgaccgaccaaacgaaggaaacggtaacggtaaccgggacacgggtaccggttaacggggtttggggtttaccgggggtacgtttaccggggaccgggggtaaccccggaaacgggggttaccccttagggggtaaccccttaacccgggttccctttcccgaccgttacccgttcccccgttaaccccgaaacccccgggg

SEQ ID NO: 330510 - DNA, 677 bp, Homo sapiens
  misc_feature: GZ8MTXP01EI221.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctgggttctcactcagcacgtaggcggaggtggggtggtgggctggactccgtcacgacccccgaaggaaacggcccgtggagtggcttgctacttctatttagtggatgatagagtaagcgactacacgcccatctctgatagaacgacggcctaaccaaccaataccgaaacccgaaacggaccgaaccctaaaccgaaaacgtacgggtacgtaccttaacaactacgaaccaaacgtacgtacggtaccctagacggacaacgacgaccaacgtattaacgttacgtcggtacaacgaacgaaggaacgaacggtaccgggactacggcggtaacgggtttgggggtttacggggaccgtttacggggaccgggggacccgaaaccgggggttaccccgttcgggtaacccgtacccggttccttaccccgaccgttaccggaaccccttaaccgtaaaccccggg

SEQ ID NO: 330511 - DNA, 701 bp, Homo sapiens
  misc_feature: GZ8MTXP01C3VNR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacgcctggagtgcttgcactcatttagtggatgatgatagcgctacacgccatctctgatagaacaggctaacaccaactacaaccgaaacggaccgaccctaacccgaaaaaaccgtcgggttacgttacccttaacaaactacgaaaccctaacacgttacggacccctgtacgggaacaccgaacgacccaacgtaactttaacgtttaacctacgggttacgaaccaaccgaaggaaacggtaacggttaaacccgggggccgtaacgggtaccggtaaacggggtttcgggggttttacggggggacccgttaaccgggttcggggggaacccccgttaaacgggggttaacccccgttgggggtaacccctaaccccgggttcccttaccccgttaccgacccgtcccccgttaaccccgaaacccccgggg

SEQ ID NO: 330512 - DNA, 637 bp, Homo sapiens
  misc_feature: GZ8MTXP01DGQZT.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccgaggaacggcctggagtggcttgcactctatttagtggatgatagatagcgctacacgcccatctctgatagacagctacacnctacaaccgaacggaccaccctaaccaaaacgcggtacgtaccttaacaatacgaaccaaacacgtacggacccttaggacggaaccacgacgacccaacgtaacttacgtttaacgtggtacaccgaacgaagaaagagttacggtacggggactacgggtaaccgttaacggggttgggggttttacgggggaccgttacgggttcgggggacccggttacggggttaaccccggttcggggttaccctaacccggttccctacccgttaccgaaccggttcccctaaccccgg

SEQ ID NO: 330513 - DNA, 597 bp, Homo sapiens
  misc_feature: GZ8MTXP01AGQH0.4.75.G09.1.454.CMB.2.raw
  modified_base (254)..(254): a, c, t, g, unknown or other
  misc_feature (254)..(254): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcagctgctcgtggagtataaaggtggggataagtattggtttgtggtancagcaagacgccaggccacgtcccctgtcgctggtcatctattatgactaccgagccggccctgacgggtacctcccgtgacgtcgtattccgtcgtcggcctacccgaactcgtacgggaacacgacgcctactctagaccatcgacggccgggacccaggtactagtacggagttcggacgggtctacggtacttacgttacgtcgtcggaacgggtccggtagggaccagccgacgtccctacttcccgttagttccggttacgttccggaccgttcggttaccgggaacccgtaacggtcctacccggttccgttacggtaaccgaaccggaacccccg

SEQ ID NO: 330514 - DNA, 521 bp, Homo sapiens
  misc_feature: GZ8MTXP01C42TX.4.75.G09.1.454.CMB.2.raw
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttatggatgatgatagcgctacagcccatctctgatgacaggctacacntcacaacggcacccacaaacagtcgtacttacaatnaaccacatcgaccctgtacggacacagaccacgattattactcgtgcacgagagagtacgggacagctcggtgggttggggcgttcgtcggggccgacgggccgttcgggtcacccgtctcccgtcacgtcccgttccgaaccccgg

SEQ ID NO: 330515 - DNA, 706 bp, Homo sapiens
  misc_feature: GZ8MTXP01B532N.4.75.G09.1.454.CMB.2.raw
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggcctggagtggcttgcactctatttatggatgatgataagcgctacagcccatctctcgatgaacnggctacaccnctcaaccaaacggaccgaccctaaccgaaaaaccgtgggttaccggtaccttaacaatcgaaacccaaactacgtccgggtacccctggtacgggaaccaccgaacgtaccccaacgtaactttaacgtttaaccgttgggttaccgaccgaaacccgaaggtaaacggaacggttaaccgggggacgtaacgggtacccgtaacgggggtttcggggtttttaccggggggggaacctttaccggggtacggggggaaccccgttaaacggggggttaaccccccttcggggtaacccgacccccggtttccgttaccccgttccgaaccggtcccccgttaacccggaaaaccccccgggg

SEQ ID NO: 330516 - DNA, 700 bp, Homo sapiens
  misc_feature: GZ8MTXP01ED9UQ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcagcccccaggaaacggccctggagtggcttgcactcatttagtggatgatgataagcgctacagcccatctctgatagaacaggcctaaccaccaagtaccaaacccgaaacgggaccgaccctaaccgaaaaaccgtacgggttacggttacccttaacaaactacgaaacccaaacgtaacgttacgggaaccccgttggtacggaaccaaccgaacgaccccaaaccgtaatttaaactttaacccgtaggttacggaaccaaccgaaggaaaggtaacgtaaccgggggacaacgggtcgtaaccgggtttgggggtttacgggggccgtttaaccgggtacggggggacccgttaaccgggggttaaaccccgttcggggttaacccgtaaccccggttccttccccgtaccgaaccggtcccccttaaccccggaaaccccggg

SEQ ID NO: 330517 - DNA, 609 bp, Homo sapiens
  misc_feature: GZ8MTXP01EN42I.4.75.G09.1.454.CMB.2.raw
  modified_base (339)..(339): a, c, t, g, unknown or other
  misc_feature (339)..(339): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcactcccccaggaaacggccctggagtggcttgcactctattatggatgatgatagcgctacagcccatctctgatgaacagctacacntacaaccgaacgaccgaccaccaaaacgaggtacgtacctaacaatacgaaccaacaatcgggaaccctggtacggacaacgacaccacgaattaacttaacctgtacgaccacgaaggaacgacgtaaacggggccaaggccgtaacgggtttgggggtttcgggggccttacggggtcgggggaccccggttaacgggggttaacccccgttcgggtccacccggttccctcccggttaccacggtccccttaacccgaaaccccggg

SEQ ID NO: 330518 - DNA, 661 bp, Homo sapiens
  misc_feature: GZ8MTXP01DINCA.4.75.G09.1.454.CMB.2.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
tcagagcactgtagcacgaccggtgctcgatttagtatagacatcaggggctgggcctcaggaagcagcatcggaggtgcctcagccatggcatggatccctatcttcctcggcgtccttgcttactgcacaggatccatggcctcctatgagctgactcagccaccctcagtgtccgtgtccccaggacagacagccagcatcagctgctctgganataaagtggggatagtatgttgtgtatnagcagacgcacggcacgtcccctgtcgtcgtggtcattctatttatgactaccgaagccggccctacgacgggactccgtgacgcgtaacttcctcgtcggtacctacccaacgtccgtagggaaaccacgacgccctaacttcgacgaacctagtaccgaacgggcccgggaaccccgagggtaccttaaggtcgggaagtagggggacggtccgttaaggtaaccttaagtttaccgtcggttaccggaacgggggtccgggttaagggggaacctacggggccaacgggtcccttaaacccgtttccccgttaagtttccggttccgtttaccgggccgttaaccgggttaacggggaaaccctaacggggtcccgtaacccggttaccgtaacgggttcccgaaaccccggg

SEQ ID NO: 330519 - DNA, 677 bp, Homo sapiens
  misc_feature: GZ8MTXP01EULEK.4.75.G09.1.454.CMB.2.raw
  modified_base (329)..(329): a, c, t, g, unknown or other
  misc_feature (329)..(329): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcaccttctctgggttctcactcagcacgtagcggtaggtggggtggtggggctggatccgtcacggacccccgaggaaacggcccgtggagtggcttgcactctatttagtggatgatgataagcgctacngccatctctgatagaacaggcctaacaccaactaccaaccgaacggaccgaccctaacccgaaaaccgtacgggtacggttaccttaactaactacggaaccaaactaacgtacggtaacccgtaggtacgggccgaaaaaaaaaacccgacgaacctaacgttaactttaacgttacgtacgtacgacgaacgaacggaacggtaacggtacgggacgacggtacggtaacgggttcggggttacggggtacggttacgggtaccggggtaccggttaccgggttacccgttccggtcccgtacccgtcccgtccgtaccgaccgtaacccgttaacccgaacccgg

SEQ ID NO: 330520 - DNA, 712 bp, Homo sapiens
  misc_feature: GZ8MTXP01B2RD4.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcactttgaaggagtctggtcctacgctggtgaaacccacacagaccctcacgctgacctgcaccttctctgggttctcactcagcactagcggagtgggtgtgggctggatccgtcacgcccccaggaacggccctggagtggcttgcactctattattggatgatagataagcgctacacgccatctctgatagaacaggcctacacccaactaccaaccaaacgggaccacccctaaccgaaaaaccgtacgggttacggtaccctttaacaaacgttcggaaacccaaacgtacgttaccgggaacccgttacggacgggaaccaacgaacggacccctaacgtaaactttaacgtttaaaccgtggttacgaacccgaaacgaaggaaacgggacgttaaacccggggggacaacgggccggttaaccggggttaggggtttttcggggggacctttaccggggttaccgggggacccggaaccgggggttaaaccccgttcggggttaacccgtaccccgggttccctccccgggttccacccggtccccgttaaccccgaaacccccgggg

SEQ ID NO: 330521 - DNA, 659 bp, Homo sapiens
  misc_feature: GZ8MTXP01EQXN4.4.75.G09.1.454.CMB.2.raw
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctgggttctcactcagcactagcggaggtggggtgtgggctggactccgtcacgccccgaggaacggccgtggagtggcttgctactctagtttagtgggatgatgaatagcgactacaccccgcctatctctagatagaacaggctacaaccnctaccaaccgaacggacccgacctaaacccgaaaaccgngggttacgtaccttaacaactacgaaccaaagacgtacggtaccctaggacgaacacgacgacccaacgatttaacttaccgtggtacgaccgaacgaaggaacgacggtaaccgggggacacgggtcggtaacggggtttcgggggtttacgggggccgttacggggtccgggggccaaacccgggggttcccttacggggttccccgacccggttcctacccgtccgaacccggtccccgttaaccccggaaccccggg

SEQ ID NO: 330522 - DNA, 686 bp, Homo sapiens
  misc_feature: GZ8MTXP01D5QIZ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctgggttctcactcagcactagcggagtggggtgtgggctggatccgtcacgcccccaggaaacggcccgtggagtggcttgcactctatttatggatgatgataagcgactacacgccatctctgatagaacacggcctaaccacccaactaccaaacccgaaagggacccgacccctaaacccgaaaaaaccgtacgggttacggtaacccttaacgaaagtacgaaaccaaactaacgttacggaaccccgtggtaacgggacaacgaccgaacccaagtaattaacgttaccgttagtaggacccaacgaaggaaggaaacgtaccggggactaaacggccggttaaacgggttgggggttttacgggggactttaacggggtccgggggaaccgaccgggggttaaaccccttcggggaaccctaccccgggttcctccccgtacgaccggtcccccgttaacccgaaaccccgggg

SEQ ID NO: 330523 - DNA, 780 bp, Homo sapiens
  misc_feature: GZ8MTXP01DOADN.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccagggaaacggcccgtggagtggcttgcactctatttagtgggatgatgataagcgctacacgcccatctctgatagaacgaggctaccaaccaactaccgaaacccaaacgggacccgacccctaaacccgtaaaaaaccgtacggggttaccggttaccctttaaacgaaacgttacggaaacccctaaacgtaacgttaccggggtaacccccgttagggttaaccggggaaaccaacctaaaccgaccccaaaacgtttaactttaaacgttttaacccgttagggttaccggaacccaaccgtaaaggaaacgggttaacggtaaccgggggtaccaacggggtcccggttaaaccgggggtttgggggtttttaacggggggtacccttaaacgggggttccggggggaaccccgttaaaccggggggttacccccgtttagggtaaccccgtaaccccgttcccgtttaccccgtcggaccgttaacccccgttaacccggtaaaacccccgggg

SEQ ID NO: 330524 - DNA, 613 bp, Homo sapiens
  misc_feature: GZ8MTXP01A8IOL.4.75.G09.1.454.CMB.2.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttatgggatgatgatagcgctacagcccatctctgatgaacngctacacntcaccgaagccgacctaccaaaaccaggtcgtaccttaacgaaatcgaaccaacacgtcggtaacccctgggtacggaaccaacgacgaccccaacaattaacttaacctgtacgccaacgaggaagacgtaaccgggggacaacgggccgtaacgggtttcgggggtttagggggccgttaacggtcggggggtacccaacgggggttacccccttcggggtaacccaccccggttcctccccgtacgaccggtccccttcccgaaaccccgg

SEQ ID NO: 330525 - DNA, 657 bp, Homo sapiens
  misc_feature: GZ8MTXP01D2X7X.4.75.G09.1.454.CMB.2.raw
  modified_base (322)..(322): a, c, t, g, unknown or other
  misc_feature (322)..(322): n is a, c, g, or t
tcagagcactgtagcacgaccggtgctcgatttagtatagacatcaggggctgggcctcaggaagcagcatcgggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtagggaagtaagtaaaggttgggggtaataaggttattgtttgttaggtatcagcgaagaacgccgaggccctacgtcccctggtcgcttggtctattctattangaactaccgaagccgaccctagacggtacctcccgtagacgtcgtacttccgtcgtcggtccctacccgaaacgttcgtacgggaacacgaccgccctactcgtacgacctagtccgaacgggaccggacccgaggtcttaagtggagtacggacggggtctacggtaacttacgttacgtcgtacggagggtaccggtaggggacacggtaccgcggtaaacctcccgttaccgttacgttcggttccgtttacccgggacgttccgggttacggggtaaccctaacgggtcccgtaaccggtaccgttacggtaacccgaaccgggaaccccg

SEQ ID NO: 330526 - DNA, 679 bp, Homo sapiens
  misc_feature: GZ8MTXP01BYCPE.4.75.G09.1.454.CMB.2.raw
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctgggttctcactcagcactaggcggaggtgggtgtgggctggactccgtcacgccccgaggaacggcccgtggagtggcttgcgtactctatttagtggatgatagataagcgctacacgcctatctctgatacgaacacggctacaaccnctaccaaccgaaacggacccgaccctaaccgaaaaaccgtggtacgttaccttaacaacgtacgaaccaaanacgtacgaccctaggacgaacacganacccaacgtaacttaattaccgtgtacggacaaacgagaacggtaacgtaccgggacacggccggttaacgggttcgggggtttacggggtaccgttaccggggttaccgggggaaccccggaaccgggggttaccccggttacgggtttccccgaaccccggggttccctttaccccgtaccgacccgggtaacccccttaaccccggtaaaaccccgggg

SEQ ID NO: 330527 - DNA, 779 bp, Homo sapiens
  misc_feature: GZ8MTXP01EAXYG.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggtcctcactcagcactagcggagtgggtgtgggctggatccgtcacgcccccaggaaaggccctggagtggcttgcactctatttatggatgatgatagcgctacagcccatctctgatagaacaggcctaccaccaagtaccaacccgaaacggaccgaccctaaccaaaaaacccgagggttacggtaccctttaacaaacttacggaaacccaaacgtaacgtcgggtaaccccgttgggtacgggaacccaaaccgaacggcccctaaacgtaaactttaaacgttttaaaccgttcggttacgaccgtaaacccgtaagggaaaaccggtacggtttaaaccccgggggacgtaaaccggggtccggtaaacccggggttttcggggggtttttacggggggggtaaccccgtttaccggggttaaccggggggggacccccgggttaaacccggggggttaaaacccccggtttccgggggttaaccccgtaacccccgggtttccccgttccccgttaccccgacccggggttcccccttaaccccccggtaaaaccccccggggg

SEQ ID NO: 330528 - DNA, 722 bp, Homo sapiens
  misc_feature: GZ8MTXP01AQJI0.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcgggagtggggtgtgggctggatccgtcagcccccaggaaaggccctggagtggcttgcactcatttatgggatgatgataagcgctacacgcccatctctgatagaacgacggctaccaccaactaccaacccgaaacggacccgaccctaacccgaaaaaaccgtacgggttaccggttacccttaacgaactacgaacccctaaagtaacgtacgggaaccccgttgggtacggaaccaaccgaacggacccctaaaccgtaaatttaacgtttaaccgttacgggttacggtaaacccaaccgaaaggtaaacgggaaacggttacccgggggacaacgggccggttaaacggggtttcgggggttttacggggggaccgttaccgggtacggggggtacccgaacgggggttaaacccccgttcggggtaacccgtaacccgggtcccgttccctaccggaccgtaaccccgttaaccccgaaaccccgggg

SEQ ID NO: 330529 - DNA, 539 bp, Homo sapiens
  misc_feature: GZ8MTXP01DPQBA.4.75.G09.1.454.CMB.2.raw
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcagcactagcggagtgggtgtggggctggatccgtcacgcccccaggaaacggccctggagtggcttgcactcattattggatgatgataagcgctacagcccatctctgatagaacagctaacacaatcaacaacggacacctaccaaaacgagtcgtaccttaanaactgaaccaagactcgaccctgacgacacganacccanatattactagcgcacagagagtcggacagcgtaacggtgggttggggcttacggtcggggccacgggacccgttcggccaccggtccctaccgtcacgccccgttaacgaaccccg

SEQ ID NO: 330530 - DNA, 709 bp, Homo sapiens
  misc_feature: GZ8MTXP01CH7Y9.4.75.G09.1.454.CMB.2.raw
  modified_base (700)..(700): a, c, t, g, unknown or other
  misc_feature (700)..(700): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctgagtcgtccgtcgtcccgaggacagacacgccagcatcagtctgctcgtaggaagtaagttaagggttagggggtaattaaggttgttggttttaggttagtatacgagacgaaggacgccgacggcctaccgttccccgtggtcgtcgttcggtactattacgttattacgtacgtaactaaccgacggtcccgtacccgtaggtaacgggtacccccttccgtggacgtaccgttactttcccgtcggtcggtaccctaaccctaaccggtccggtaaacgggaaccacggtaccgtaccctaccgttaccgacggtaacctacgtaccgggaacccggggtacccgggtaacccgagggttacgttagtacggggagtacggtacgggggtctaaggttaaccttagttacgtcggtacgggacgggttaccggggaggtacacggcgcgtaacctacccgttccttgccgttcgttcggacgttcgggttaccgaaccgttacggcctaaccggcgttacggaaccncgaaccccg

SEQ ID NO: 330531 - DNA, 710 bp, Homo sapiens
  misc_feature: GZ8MTXP01DSM7Q.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggttctcactcagcactagcggtaggtggggtgtgggctggactccgtcacgccccgaaggaacggccgtggagtgctgcactctatttagtggatgatgataagcgactacacgccatctctgatagaacgngcctaacaaccaactaccgaaaccgaaacgggaccctaaccctaaacccgaaaacgtacggttaccgtaaccttaacgaaacgtacgaaacccaaacgaacgtcggaccctaggacgaaaccacaacgaccccaagtaactttaacttaacgtacggtacgaaccgaagaacggtaaacgtaacggtaaccgggggactacgggaaccggttaaccgggggtttgggggttttacgggggaccgtttaaccggggaccggggggtaacccgttaaccggggggacccctttacgggggtaaccccttaacccggttccccgttacccgttaccggaccccgggtccccgttaaccccggaaaccccggg

SEQ ID NO: 330532 - DNA, 640 bp, Homo sapiens
  misc_feature: GZ8MTXP01DKCR5.4.75.G09.1.454.CMB.2.raw
  modified_base (485)..(485): a, c, t, g, unknown or other
  misc_feature (485)..(485): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtagggaagaagttaaaggttggggggaaattaaggttattggttttgttaggtatcgaagcgagaaacgccgaaggcccacgtcccctgtcgtctggtctagttcttaattatacgaactaacccgaaggcccggtaccctcggacgggtaccctccccgtaggacgtccgtactttccgtcgtcggacccttacccgaaacgttccgtaacgggaaccacgacgaccctaacgtctacgaccagtcgaacggcccggaccaggctagnggactggaacggggtctagtacttacgttacgtggtacgacggggtacggtacggacagaccacggtcctaccgttccctagttcgttccgttcgggacttccgggttacggaaccctacggtccacccggtcgttacggtccaacggaaccccg

SEQ ID NO: 330533 - DNA, 723 bp, Homo sapiens
  misc_feature: GZ8MTXP01BXNKW.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaggcccgtggagtggctgcactctattagtggatgatgatagcgctacacgcccatctctgatagaacacggctaacaacccnctaccaaacccgaaacggacccgaccctaacccgaaaaaacccgtacgggttacggtacccttaaacaaacgtacgaaaccctaaacgaacgtacgggtacccctagggtacggaaccaaccgaacgaccctaacgtaactttaactttaacccgtaggttacggaaccaaccgaaaggtaacggtaacggttaaccgggggacgaacggtaccggtaacccggggtttaagggggttttcgggggtacccggttaacgggttccggggggaacccgttaacggggggttaaaaccccgttcggggtaaccccgtaccccgggttccttaccccgtaccgttaacccgggtcccccttaacccgtaaaacccccgggg

SEQ ID NO: 330534 - DNA, 658 bp, Homo sapiens
  misc_feature: GZ8MTXP01AEITX.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgggttctcactcagcactagcggagtgggtgtgggctggactccgtcgacgcccccgaggaaacggcccgtggagtggcttgcactctatttagtggatgatgataagcgctacacgcccatctctgatgaacaggctaaccaccaactccaaacccgaacggaccgaccctaaccgaaaaaccgtcgggtacggtaccttaaacaacgtacgaaacccaaacgtacgtaccgggtaccccgtggtacggaacaaccacgaaccccaacgtaacttaagtttacctaggtacgaccaacgaagaaggtacgtaacgggggacacggtccggtaacgggtttggggttcgggggaccttaacggggtccgggggacccgttaacgggggaccccgttcggggtccctacccgggttcctcccgtccgaccggtccccttaaccggaaccccgg

SEQ ID NO: 330535 - DNA, 615 bp, Homo sapiens
  misc_feature: GZ8MTXP01A96U8.4.75.G09.1.454.CMB.2.raw
  modified_base (252)..(252): a, c, t, g, unknown or other
  misc_feature (252)..(252): n is a, c, g, or t
  modified_base (602)..(602): a, c, t, g, unknown or other
  misc_feature (602)..(602): n is a, c, g, or t
tcagagcactgtagcacgaccggtgctcgatttagtatagacatcaggggctgggcctcaggaagcagcatcggaggtgccgtcagccatggcatggatccctctcttcctcggcgtccttgcttactgcacaggatccgtggcctcctatgagctgactcagcccaccctcagtcgtccgtgtcccccaggacagacagccagcatcagctgctctggagataaagttgggggataagtatgttgtggtancagcagaagccagccagtcccctgtgcgtgtcatctattatgactaccaagtccggccctgacgggacctcccgtgacgcgtatttcctcgtggccctacccgaaacgtcgtaggggaacacacgccctaactctcggaaccctagtccgacgggcccgggaacccagggccgttagtgggattcggaggggtcctaggtaaaccttacgtttaaccgtggtcgaacgggtccgggtagggacccaggaccacggtcctaacccttccccgttaagttcccgtttaccgtcggacgttaccggttcgggaacccgtaacgggtccctacccggtacgttacgggtaaccncccgggaaccccg

SEQ ID NO: 330536 - DNA, 687 bp, Homo sapiens
  misc_feature: GZ8MTXP01BK4GD.4.75.G09.1.454.CMB.2.raw
  modified_base (335)..(335): a, c, t, g, unknown or other
  misc_feature (335)..(335): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcacgcccccaggaaacggccctggagtggcttgcactcatttagtggatgatgataagcgctacagcccatctctgatagaacnggctaccaccaactaccaaccgaaacggaccgacccctaacccgaaaaaaccgtacgggttacggttacccttaacgaactacggaacccaaactacgtacggaccccttaggtacggaacaaccgacgaccctaacgtaatttaacgttaaccgtggtacgaccaacgaaggtaacgaacgttaacgggggactaacggccgttaacgggggttcggggttttacgggggaccgtttaaccgggtcggggggtaacccgaaccggggggttaacccccttgggggttaacccctacccgggttccttccccgtaccgttaaccgggtccccttaacccgaaacccccgggg

SEQ ID NO: 330537 - DNA, 590 bp, Homo sapiens
  misc_feature: GZ8MTXP01ENC6Q.4.75.G09.1.454.CMB.2.raw
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggcccgtggagtggcttgcactctattagtgggatgatagataagcgactacagcccatctctgatagaacagctacacntacaacgaacgacgacctaacaaaacgaggtacgtacctaanaactacgaaccaaacacgtacggaccctaggtacggaacacaacaccaactaattattaactgacacaacgagaagacgtacgggcacggcgtaacgggttgggtttcgggggactttacgggtcggggacccgaacggggttaacccttcggttaaccgaccggtcctcccgtacgaccgccccgttaaccgaaaccccggg

SEQ ID NO: 330538 - DNA, 626 bp, Homo sapiens
  misc_feature: GZ8MTXP01CPIBR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggccggatccgtcacgccccgaggaaggcccgtggagtggcttgcactctatttattgggtatgatgataagcgctacacgccatctctgactagaacaggctcaaaccatccaccgaaacgggaccgaccctaaccgaaaaaccgacgggtacgtacccttaaacaacttacggaacctaaacgagtacggaccccgtagtacgggacaaccacggaccaactagttaactttacgtgtgacaacgagagaagtacggggctaggcgtaacgggttgggtttacggggcgttaacggttcgggggaacccgcggggttaaaccccgttgggttacccaacccggttcctcccgtacacggccccttaacccgaaccggaaacccggg

SEQ ID NO: 330539 - DNA, 601 bp, Homo sapiens
  misc_feature: GZ8MTXP01ALRQX.4.75.G09.1.454.CMB.2.raw
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
  modified_base (463)..(463): a, c, t, g, unknown or other
  misc_feature (463)..(463): n is a, c, g, or t
  modified_base (556)..(556): a, c, t, g, unknown or other
  misc_feature (556)..(556): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctgggatccgtcacgcccccgaggaacggcctggagtggcttgctactctagtttagtgggatgatgataacgcgctacagcccatctctgatgaacagctaccacccntaccaaccgaaacggaccgacctaacccgaaaacgtcgggttacgtacccttaanaactacgaaccaacgacgtcggaccctgtacggacacgacgaccacgtattaacgttcnggtcacacgagtagacgtaacgggcaacgccgtaagggttgggtttcggggacttcgggtcggggacccgacggggacccttggggtaacccncccggttccgtacccgcgttaccggcccttaacccgaaccccggg

SEQ ID NO: 330540 - DNA, 565 bp, Homo sapiens
  misc_feature: GZ8MTXP01ACUMZ.4.75.G09.1.454.CMB.2.raw
  modified_base (248)..(248): a, c, t, g, unknown or other
  misc_feature (248)..(248): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcagctgctctggagataaagtgggggataagtatgtttgtgtancagcagagccaggcctagtcccctgtgctggtcatctattatgaactaccgaagccggcctcgacgggactcccgtgacgtcgatttccgtctcggctacccaaatcgtagggaacacgacgacccactctacgaccagtccgaacggaccgggacccgaggacctagtggattcggagggctagtacttattaccgtggtcgaggtcggtcggcgagcagcctaaccttcccgttattcgttacgttccgggacttaccggttacggggaacccgtaaggtccgacccggttcgacgggtccaaccggaaccccgg

SEQ ID NO: 330541 - DNA, 695 bp, Homo sapiens
  misc_feature: GZ8MTXP01BAI0D.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctggttctcactcagcactagcggaggtgggtgtgggctggatccgtcacgccccgaggaacgcccgtggagtggctgcactctagtttagtggatgatagatagcgactacacgcccatctctagatagaacgaggcctaaccaacctaactaccaaacccgaaacgggacccgtaacccctaaacccgaaaaaccgtacgggtttaccgttaaccttaaacgaaacgtacgaaaccctaaacgtaacgtacgggtacccctagggtaccggaccaaccgaacgacccaacgtaattaacgttaccgtggtacgaaccgaacgaggaacgtaacggtaccggggactacgggtacggtaacggggtttcgggggtttacggggaccgttaccggggtccgggggacccgttaaccgggggttaccccgttcgggtaacccgtacccgttccgtcccgtaccgaccggtccccgttaacccgaaccccggg

SEQ ID NO: 330542 - DNA, 608 bp, Homo sapiens
  misc_feature: GZ8MTXP01BEG35.4.75.G09.1.454.CMB.2.raw
  modified_base (342)..(342): a, c, t, g, unknown or other
  misc_feature (342)..(342): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttggcactcatttatggatgatgatagcgctacagccatctctgatgaacaggcctacaaccnctaccaacccgaaggaccgaccctaaccaaaaacgtacgggtacgtaccttaacaatcggaaccaaacagtaccggtaccctggtacggaaccactacgacccaagtaacttaattacctagtacgacgaccgaaggagtacgtacggggactaggccgtaacggttggggttcggggcgttaacggcgggggtccgaacgggttacccgttcgggtaacccacccggtcctacccgtcgacgtccccgttaacccgaaccccggg

SEQ ID NO: 330543 - DNA, 627 bp, Homo sapiens
  misc_feature: GZ8MTXP01DDQ4P.4.75.G09.1.454.CMB.2.raw
  modified_base (490)..(490): a, c, t, g, unknown or other
  misc_feature (490)..(490): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcagcacgtagcggagtggggtgtgggctggatccgtcacgacccccgaagggaaacggcccgtgggagtcggcttgctactctatttagtggatgatgataagcgactacacgccatctctagatacgacgacgcctaaccaaccaactaccaaaccgaaacggtaccgaccctaacccgaaaacgtacggtacgttaccttaaacaatcgaaccaaagacgtcggaccctgacgaacaccgaacgccaacgtaacttacgttaaacctggtanaccaacgaggaacgaagtaccggggatacgggcgtaacgggttggggtttcggggcgttacggtcgggggaccgttaaccgggttaccgttcggtaaccctaccggtcctcccgtcacgtccccgttccgaacccgg

SEQ ID NO: 330544 - DNA, 562 bp, Homo sapiens
  misc_feature: GZ8MTXP01AQ674.4.75.G09.1.454.CMB.2.raw
  modified_base (342)..(342): a, c, t, g, unknown or other
  misc_feature (342)..(342): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaacggcccgtggagtggcttgcacgtcatttatgggatgatgatagcgctacagccatctctgatgaacaggctacaccntccaaccaaagggaccaccctaccaaaaaccgaggtacggtccttaacaatcgaaccaacatcggacctgtcggacacagaccacgtatattactgtgcacagagtagtacgggacagcgtaacggtgggtttcggggcgttacggtcgggggccgacgggggacccttcggggtccacccggttccgtcctcgaccgtcccgttaacccgaaccccggg

SEQ ID NO: 330545 - DNA, 766 bp, Homo sapiens
  misc_feature: GZ8MTXP01A9WP1.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcagcacgtagcggaggtgggtgtgggctggactccgtcacgcccccagggaacggccgtggagtggcttgcactctatttagtgggatgatgataagcgctacgacgcctatctctgatagaacgacgcctaaccaaccaactaccaaaccgaaacggacccgtaccctaaacccgaaaaacgtacgggttaccgttaccttaaccgaaactacggaaaccctaaacgtaccgtaccgggtacccctagggtacggaacccaccgaacgaccccaaacgttaaacttacgtttaaacgtcgggttaaccgaccaacggaaagggtaaacggtaacggttaaccgggggaccgaaacgggttccgggttaaaccgggggttttggggggtttcgggggaacccgttttaccgggggtacccgggggggaaccccgttaaaacggggggttaccccccgtttagggggttaaccccctacccggggtttcccttaccccggggtaaccccgttaccccgggtaacccccgttaaccccgggtaaaccccggg

SEQ ID NO: 330546 - DNA, 624 bp, Homo sapiens
  misc_feature: GZ8MTXP01EUG5E.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggatccgtcacgcccccaggaaacggcctggagtgctgcactctatttagtggatgatagatagcgactacacgccatctctgatagacagctaacacaatcaacgaacgaccgacctaaccaaaacacggtcgtaccttaacaatacgaaccaacaacgtacggacccttaggacggaaccaacgaacgaccctaacgtattaacgtttacgtacgtacgacaacgaagaaggaacgtacggggacaacggtcgtaacgggtttgggtttgggggaccgttaccggtacgggggaccccttaacgggggaaccccgttcggggttaacccacccggttcctcccgttacgacccggaacccttccccgaaaaccccgggg

SEQ ID NO: 330547 - DNA, 787 bp, Homo sapiens
  misc_feature: GZ8MTXP01DQASZ.4.75.G09.1.454.CMB.2.raw
  modified_base (388)..(388): a, c, t, g, unknown or other
  misc_feature (388)..(388): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgtgggttctcactcagcactaggcgggtaggtggggtggtgggcgtggactccgtcgacgcccccgaagggaaacggcccgtggaggtggtcttcggctactcgtatttagttgggtatgtatagagtagcgtactacacgccctaatctctagagtagaacgacggcctaaccaaccnctaccgaaacccgaaacggacccgacccgtaaaccgaaaaaccgtacgggttacggtaacccttaacgaaactacggaaaccaaacgtacgtacgggtacccttagggacggaaaccacgaaccgacccctaaacgtaaacttttaaagtttaacccgtaggttaacggacccctaaagaaggaaaaccgggtttaacgggaaccgggggtaaccgtaacgggtaacccgggttaaacgggggttttcggggggttttaccgggggtacccgtttacggggtaacccggggggtcccggttaaaaaccgggggttccccgggttacggttaacccgttaccccgggttcccttacccgccgggttaccctccccgttaaccgtaaaacccccccggggg

SEQ ID NO: 330548 - DNA, 784 bp, Homo sapiens
  misc_feature: GZ8MTXP01ATX40.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcctaccttctctgggttctcactcagcacgtaggcggtaggtggggtgtgggctggactccgtcacgcccccgaagggaaacggcccgtggagtggcttgctactctatttagttggatgatagaatagcgtactacacgccctatctctagatagaacgacggacctaaccaacccaactaccgaaacccgaaacgggtacccaacccgtaaacccgaaaaaaccgtacgggttaccgttaacccttaaacgaaacgttaccgaaaccctaaacgtaacgtaccgggaacccctgggtaacggaaaccaaccgaacgtacccctaaacgtaatttaacgtttaacccgttagggtacaaccgaaaccggaaggtaaacggtaaaccggtacgggggaccaacggggttcccggtaaaccgggggttttgggggttttaccggggggacccgttaaaccgggggttccggggggggaaccccgttaaaccggggggttaaaccccttcgggggttaaccccctacccgggttccctaccccgttaccgggaacccgtaacccccgttaacccgaaaaccccccggggg

SEQ ID NO: 330549 - DNA, 652 bp, Homo sapiens
  misc_feature: GZ8MTXP01B9WGR.4.75.G09.1.454.CMB.2.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctctatgagctgactcacgccaccctcagtcgtccgtcgtccccgaggacagacagccagcatcagctgctgtaggagtagtaagttggggataagtntgttgtgtancagcagacgccgagccacgtccctgtcgcgtgtacattctaattagacgactaccgacggccgtacctcgacgggtaccctcccgtagacgtcgtacttccgtacgtcggtacctacccgtaacgttcggtaacgggaaccaccgacgaccctacgtccgtacgaccctagtacccggaacgggcccgggaaccctagggaccttaagggcggtagtacgggtacgggtacgttaacgttaaccttacgttacgtcggtacggacgggtacggacggtacgacgaccgtaccgtaacctacccgttcgttacgttccggttccgtcgggttaccgttacgggttaccgggtaaccgtacggtcccgtaccggtacgttaccggtaaccgaacccgaacccg

SEQ ID NO: 330550 - DNA, 639 bp, Homo sapiens
  misc_feature: GZ8MTXP01EFTU6.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaaacggcccgtggagtggcttgcactcatttagtggatgatgatagcgctacacgcccatctctgatagaacgacggcctaaccaaccaactaccgaaaccgaaacgggtaccgaccccgtaaacccgaaaaccgtacgggttacggtacccttaaacgaagtacgaaccaaacgacgtcggaccccttgggacgaccacacgacccaatattacgttaccgtgacgaccaacgtagaacggaacgtaccggggcacggcgtaaccgggttggggtttcggggaccttacgggtccgggggaccgaacggggttacccttcgggtaacccacccggttccgtcccgtacgaccgtaaccccgttccgaaccccggg

SEQ ID NO: 330551 - DNA, 581 bp, Homo sapiens
  misc_feature: GZ8MTXP01CUS4G.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatggatcttgtcccagatcaccttgaaggagtctggtcctacgctggtacgaaacccacacacgaccctcacgctgacctgctaccttctcgtgggttctcactcagcacgtaggcgggtaggtgggtggtgggctggactccgtcgaccgccccgaggaacggcccgtggagtggcttgctactctatttagtggatgatgaatagcgactacacgcctatctaccgtagagtgaacacggacctacaaccactaccaaccgaacggaccgacctaaaccgaaaaccgtacgggttacgtaccttaacgaactacgaaccaactacgtcgaccctgacgacacacgacatattacttagcgtgacacgaggactaggacggcagcgtggttgggtcgggcgtacgggtcgggaccgacgggttaccctggtccgaaccgtctccgactccgttcccgaacccg

SEQ ID NO: 330552 - DNA, 614 bp, Homo sapiens
  misc_feature: GZ8MTXP01BEJ8O.4.75.G09.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctcgtggagataaagttgggggataagtatgttgtgtancagcagagccaggccacgtcccctgtcgctggtcatctattangactaccgagccgtcctacgacggacctccgtagacgcgtacttctcgtcggacctaccgaactcgtacgggaacacgacgcccactctacgaccacgtcgacggaccgggtaacccagggtacctagtcggaagtcggaacggggtcttaggtaaccttagttaccgtcggtacgtaacgggtccgggtaggggtaccacgggccaccggtccctaacccgttccccgttaagttcgttccgttacgggccttacgggttacggggaacccgtacgggtaacccaccgggttaccttacgggttcccaaccgggaaaccccg

SEQ ID NO: 330553 - DNA, 641 bp, Homo sapiens
  misc_feature: GZ8MTXP01B57OM.4.75.G09.1.454.CMB.2.raw
  modified_base (274)..(274): a, c, t, g, unknown or other
  misc_feature (274)..(274): n is a, c, g, or t
  modified_base (425)..(425): a, c, t, g, unknown or other
  misc_feature (425)..(425): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgctaccttctctggttctcactcagcacgtagcggaggtgggtgtgggctggactccgtcacgccccgaggaacgccgnggagtgctgcactctagtttagtggatgatagatagcgactacgacgccatctctgatagaacgagcctaacaccaactaccgaaccgaacggacccgaccctaacccgaaaaacgtacgggttacgtaccttaacaacgtacaaccaaanacgtcgacccgtgtacggacacacgacctaacgtattaacgttaccgtagtacgaccgaacgaggaacgtaacgtaccgggactacggcgttaacggggttgggtttacggggaccgtttacgggaccgggggtaccgttacggggttaacccgttcgggtaacccctacccggttcctcccgtacgacccgtccccgttaacccgtaaccccggg

SEQ ID NO: 330554 - DNA, 613 bp, Homo sapiens
  misc_feature: GZ8MTXP01AVAZD.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaggccctggagtggcttgcactcatttatggatgatgataagcgctacagccatctctgatgaacaggctacaccaactcaaccaaggaccgacctaaccaaaaaccgagggtacggtaccttaacaatacgaaccaaacacgtcggaccctggtacggaacaacagcccaacattattaacctgtagccaacgagaacgtacgtaaccggggctacggcgtaacgggttggggttttcgggggccgttacgggttcggggggacccgttaacgggggttaaccccttcgggggtaacccctacccgggttcccttcccgttacgaccgtccccgttcccgaaaaccccggg

SEQ ID NO: 330555 - DNA, 581 bp, Homo sapiens
  misc_feature: GZ8MTXP01BYGZ1.4.75.G09.1.454.CMB.2.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttatggatgatgatagcgntacagccatctctgatgaacngctacaccntacaaccaagaccgaccctaacaaaaccgaggtcgtaccttaacaatcgaaccaagacgtcggacccctggtacggaccaacacgacccaacgtaacttagttacctgtcgacaacgaggaacgacgtacgggcacgcgaacgggttggggtttcggggacttaacgggtcgggggaccgaacggggttacccgttacggtccgacccgtcctacctcgaccgcccgttaacccgaacccggg

SEQ ID NO: 330556 - DNA, 734 bp, Homo sapiens
  misc_feature: GZ8MTXP01A7Q4E.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcaccttctctgggttctcactcagcacgtagcgggaggtggggtgtgggctggactccgtcacgaccccgaggaacggcccgtggagtgctgctactctattagtggatgatagatagcgctacacgcctatctacgtgatagaacgacgcctaacaccaactaccgaaaccgaaacgggaccctaaccctaaaccgtaaaaaccgtacgggttacgttaccctaaacaacgtacgaaccctaaacgacggtaccggacccgtaggaccggaacaaccgacgaccctaacgtaactttaaacgtttaccgtaggtaacgacgtaaaccgaaagggtaaacggtaacgggtaaccgggggtaccaacggggttaccgggtaaccgggggttttacgggggtttccggggggtaaccggttaccgggggtacccggggggtaacccgggttaaccgggggttaaccccgttcgggtaaccccgtaccggttcccgtacccgtccgacccggtccccgttaaccccgtaaaccccgggg

SEQ ID NO: 330557 - DNA, 687 bp, Homo sapiens
  misc_feature: GZ8MTXP01CJ1ML.4.75.G09.1.454.CMB.2.raw
  modified_base (435)..(435): a, c, t, g, unknown or other
  misc_feature (435)..(435): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtccagatcaccttgaaggagtctggtcctacgctggtacgaaacccacacacgaccctcacgctcgacctgctaccttctcgttgggttctcactcagcacgtagcggtaggtggggtgtgggctggactccgtcacgccccgaaggaacggccgtggagtggcttgctactctatttagtggatgatagatagcgactacgacgtcccagtctacgtagatacgaacgacgacctaaccaaccaactaccgaaaccgaaacgggacccaaccctaaacccgaaaaccgtcggtacgtacccttaaanaacgtacgaaccaaacgacgtacggtacccgtaggacgaaccaacacgtaccctaagtaactttacgttaactcgacgaacccgaacgaagtaacggtaccggtaacggggctacgggtacgttaacgggggttgggtttaccggggacgttacggggtaccgggggaccttaacccgggggttacccttcgggtaaccgtaccccggttcttcccgccgttaccgtcccccgttaaccggtaaaccccggg

SEQ ID NO: 330558 - DNA, 669 bp, Homo sapiens
  misc_feature: GZ8MTXP01BCZUM.4.75.G09.1.454.CMB.2.raw
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaaggccctggagtggcttgcactctatttatggatgatgataagcgctacngccatctctgatgaacaggctacaccntcaaccgaacgaccacctaccaaaacgcggtacggtacctaacaactacgaaccaacaacgtacggtacccgtacgtacggaaccgaaccaacgacccaacgtaacttctttaaaaaaaaaacctcgttacgaccgacgaacggaacgaacgttaacggggaccgaacggtccggtaacgggttcggggttttacgggggtaccggttacgggtaccgggggtaacccggaaccgggggttaaccccggttacccgggtaacccgtaaccccggttaacccgttccccgttcccgaccgtaacccccgttaaccccgtaaacccccggg

SEQ ID NO: 330559 - DNA, 635 bp, Homo sapiens
  misc_feature: GZ8MTXP01DXZJO.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatggatgatgataagcgactacagccccatctctgatagaacaggcctaacaccaataccaaccaaacgggaccgaccctaacccgaaaaaaccgagggttacggttaacccttaacgaaactacggaaaccctaaactaacgtacgggaaccccgttgtacgggaaacaccgaacgacccaaacgtattaactttaccgtgtacgacacgagacgacgtacgggctagcgtaacggttggggtttggggaccgttacgtcgggggaccttaaaccggggacccgttgggttcccaacccggttcctcccgttacgaccgtccccgttaacccgaaaccccgg

SEQ ID NO: 330560 - DNA, 646 bp, Homo sapiens
  misc_feature: GZ8MTXP01A62PL.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcgggagtgggtgtgggctggatccgtcacgcccccgaggaacggcccgtggagtggcttgcactctatttagtgggatgatagataagcgactacacgcccatctctgatagaacagctacaccaactcaaccgaacggaccgaccctaacccaaaaccgacgggttacggtaccctttaacgaacttacggaacccaaacgacgttacgggaaccccttgggaacggaaccaacgaacgaccccaacgtaattaactttaaccgtgtacgaccacgaagagtacgtaccgggcacggcgtaacgggttggggtttacgggggcttacgggtcggggggacccgaacgggggttaccccttcgggggtaaccctacccggttcctaccccggtcaccggtccccttaacccggaaccccgg

SEQ ID NO: 330561 - DNA, 701 bp, Homo sapiens
  misc_feature: GZ8MTXP01DQ12N.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcagctgctcgtaggaagtaagttaaaggtgggggtaattaaggttagttggtttagttaggtatcgagacaaggaacgccgacggcctacgtccccgtggtcgctggtctattacttattatgaactaccgacggcccgtccgtacgacggggtacctccccgtaggacgtaccgtactttcccgtacgtcggtaccctaacccgtaaaccgttacggtacgggaaacctacgaaccgccctaactctacgaacctacgacggaacgggacccgggaaccacgggtactaggtaggacgtacgggaacggtcgtaaggttaaccttaagtttaccgtgtacggtacgggtacggtacgggacgacgacacgtaacccgtcccgttacccttagttccgttaaccgttccggacccgttacgggttaccgggaaacccgtacgggttccccgtacccggtaccgttaacggtaacccgaacccggtaaccccccg

SEQ ID NO: 330562 - DNA, 763 bp, Homo sapiens
  misc_feature: GZ8MTXP01EUG8V.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccgaggaacggcctggagtgcttgcactctatttagtggatgatagataagcgctacacgccatctctgatagaacgacgcctaaccaccctaactacccgaaacccgaaacgggacccgaacccctaaacccgaaaaaacccgtacgggttaccggttaaccctttaaacaaacgttaccgaaacccaaacgtaacgtacgggtaaccccttgggacggaacccaacgaaccgtacccaaacgttaatttaacgtttaaccgtacggttacggaacctaaaccggaacggtaaaagggaaccggttaaccgggggaccgtaaaccgggtccggggttaaaccgggggttttcgggggtttttacggggggacccttttaaaccgggggtccggggggaaaccccgttaaccggggggttaaaccccctttgggggtaacccctaaccccgggttcccttccccgttacgaaccccggtccccgtttaaccccggaaaaccccgggg

SEQ ID NO: 330563 - DNA, 628 bp, Homo sapiens
  misc_feature: GZ8MTXP01ANWIG.4.75.G09.1.454.CMB.2.raw
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttagtggatgatgataagcgactacagcccatctctcgatgaacncgctaacaccntccaaccaacgggaccaccctaaccaaaaccgtagggtacgttacccttaacgaatacgaacccaatacgtacggaccctagtacggaacaaccacgacccaacgtaattaattaccgagttacgaccaacgaaggaacggaacgtcggggactacgggcgtaaccgggttggggtttcggggcttaacgggtcgggggtaccccgaacgggggttaccccgttgggtaacccgtacccgttccgttacccgtccgaaccgtcccgttaacccgaacccggg

SEQ ID NO: 330564 - DNA, 646 bp, Homo sapiens
  misc_feature: GZ8MTXP01APVL8.4.75.G09.1.454.CMB.2.raw
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtggggtgtgggctggatccgtcacgcccccgaggaaacggcccgtggagtggcttgcactctatttagttggatgatagatagcgctacacgcccatctctgatagaacagcctaacaccaactcaaccaaggaccgacctaaccaaaacacgggtacgtacccttaanaacgtacgaaccaaanacgtacggaccctagtcggaacacgacgaccctaacgaattacttacgtagtacgaccgaacgaaggaacgtaacgtaccggggactagggtccgtaaggggtttcggggtttcgggggacccgtttaacggggtcgggggaaccccgttacgggggttaaccccgttcggggtaacccctaccgggttcctacccgtaccgaccgtccccgttaacccgaaaccccggg

SEQ ID NO: 330565 - DNA, 576 bp, Homo sapiens
  misc_feature: GZ8MTXP01DN712.4.75.G09.1.454.CMB.2.raw
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctcgtggttctcactcagcactagcggaggtgggtgtgggctggactccgtcacgacccccgaaggaaacgccgtggagtggctgcatcatttagttggatgatgataagcgctacacgcccatctctgatagaacagctacacntcacaacgacacctaacaaaacngtagtaccttaagaatcgaaccaactacgacggtaaccctgacggacacacgacccagtaattaattacaggtcacacgagtaagacgtacgggacgacgcgtaacgggttggggttagggggacttacgggtcgggggtcccgaacggggttaacccgttcggggtccaccggtctccctcacgtccccttaaccgaaccccgg

SEQ ID NO: 330566 - DNA, 692 bp, Homo sapiens
  misc_feature: GZ8MTXP01DNKTA.4.75.G09.1.454.CMB.2.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
tcagagcactgtagcacgaccggtgctcgatttagtatagacatcagggtcttcgtgactcctgtcgccccaccatggacacactttgctccacgctcctgctgctgaccactcccttcatgggtcttgtcccagatcacttgaaggagtctggtcctacgctggtacgaaacccacacacgaccctcacgctcgacctgcctacctttctcgttgggttctcactcacgcacgtaggcgggtagggtggggtggtgggcgtggactccgcgaccgaccccgaagggaacgccgnggagtggtctgcatntatttagtggntgatagagtagcgactacacgcctatctcgtagacgtacgaacgacggacctaacccaaccaactaaccgaaaccggaaaccggtaacccgtaaccccgtaaaacccgaaaaaccggtacgggttaaccgtttaacctaaacgaactacggaaaacctaacgaacgttccggaacccgtggaccgaacacgacgaccctaagttaacttacttaccgtgtacgacaaacgaggtaaacgcggtaacggcacgggtcggtaacgggtttggggttcgggacgttacgggcggggtacccgttaaaccggggttccttcgggtaaccctaccggtcttacccgcgacccgtaacccgttaacccggaacccgg

SEQ ID NO: 330567 - DNA, 586 bp, Homo sapiens
  misc_feature: GZ8MTXP01DV0VT.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctgatagaacaggcctacaccaatcacccaaacggaccgaccctaccaaaaaccgagggtacggtacccttaacaaactcgaacccaaacactcggaccctggtacggaacacgacgcccaatacttatttaacctgtagcaacgagaaagcgtacgggcaggctaacggttggggttggggcgttacggtcgggggcccgaacggggacccttgggtaacccacccggtccttccccgtccgacgtcccgttccccgaacccggg

SEQ ID NO: 330568 - DNA, 546 bp, Homo sapiens
  misc_feature: GZ8MTXP01COBY5.4.75.G09.1.454.CMB.2.raw
  modified_base (174)..(174): a, c, t, g, unknown or other
  misc_feature (174)..(174): n is a, c, g, or t
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttcnctgggttctcactcagcactagcggagtgggtgngggctggatccgtcagccccaggaagcctggagtgcttgcactcatttagtggatgatgataagcgctacagcccatctctcgatgaacaggctacaccntacaacaagggaccaccaaccaaaaaccnggtagtaccttaagaatcgaaccaacattacggaccctgacgacacagacccanatattacngtgcacgagagagtaacgggcagctaacggtgggtttggggcttacggtcggggaccacggggaacccgttcggttccaaccggttcctcccgtcaacggtcccttaaccgaacccgg

SEQ ID NO: 330569 - DNA, 697 bp, Homo sapiens
  misc_feature: GZ8MTXP01E3CET.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcgggagtgggtgtgggctggactccgtcacgcccccaggaacggccgtggagtggcttgcactctatttatggatgatagatagcgctacgacgccatctctagatagaacacggcctaaccaaccaactaccaaacccgaaacgggacccgacccctaaacccgaaaaaaccgtacgggttacggttaacccttaaacaaacgttacgaaaccccaaacgtaacgtacgggtaccccgttaggacggaaccaaccgtacgaccctaacgtaacttaattaaccgtgtacgacccaaacgaggaagaacggtaccgggacgaacgggtccggtcggggtttcgggggtttacgggggacccgttacggggtcgggggaacccggttaaccgggggttaaccctttccgggaacccgtaccccggtttccctaccccgttcgaaccgtccccgttaaccccgaaacccccggg

SEQ ID NO: 330570 - DNA, 726 bp, Homo sapiens
  misc_feature: GZ8MTXP01CGTLU.4.75.G09.1.454.CMB.2.raw
  modified_base (587)..(587): a, c, t, g, unknown or other
  misc_feature (587)..(587): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgttgggttcctcactcagcacgtagcgggtaggtgggtggtgggctggactcccgtcacgaccccgaggaacggccgtggagtggcttgctactctatttagtggatgatgaagtaacgcgactacgacgtcccatctcgtagactacgaacgacgtcctaaccaaccgtaactaccaaacccggaaacgggtacccgaacccctaaacccgtaaaaaccggtacgggttaccggttacccttaaacgaacttaccggaaacctaacgaacgttccgggaaacccgtggtacgggaaccaacgaaccgtaccctaaacgtactttaacgttaaccgtttagggacaccgaaaccgaaggaacgtaacgggtaccgganaaaccgggtcggtaaccggggtttgggtttcgggggaccttacggggtaccggggtaccgaaccggggttacccgttgggtaaccccgtaccgttcccggtcctacgttaacccgtccccgttaaccggtaaaccccgg

SEQ ID NO: 330571 - DNA, 626 bp, Homo sapiens
  misc_feature: GZ8MTXP01EGCT7.4.75.G09.1.454.CMB.2.raw
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgctaccttctcgtggttctcactcagcactagcggagtgggtgtgggctgactccgtcgacgaccccgaggaacggccgnggagtggtcttcgctactctatttagtggatcgatagagtaacgcgactacgacnccctatctctgatagaacgcgcctaaccaccnctaccaaaccgaacggaccctaaccgaaccgaaaaccgtgggttacctaccttaanaactacgaacccttaagacgttacggacccgttagacggaacccaacgactaacccagtaatttagtaacctggcaccaagaggaaccgtagtaacgggcctaaggcccgtaaggttcggggttggggaaccttcgggacggggaccacgggttacccttcgggtaacccacgttcctccacgacgtcccccttaacgaaccccggg

SEQ ID NO: 330572 - DNA, 614 bp, Homo sapiens
  misc_feature: GZ8MTXP01ETR75.4.75.G09.1.454.CMB.2.raw
  modified_base (427)..(427): a, c, t, g, unknown or other
  misc_feature (427)..(427): n is a, c, g, or t
  modified_base (463)..(463): a, c, t, g, unknown or other
  misc_feature (463)..(463): n is a, c, g, or t
  modified_base (483)..(483): a, c, t, g, unknown or other
  misc_feature (483)..(483): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtccagatcaccttgaaggagtctggtcctacgctggtacgaaacccacacacgaccctcacgctcgacctcgcctaccttctcgtgggttctcactcagcacgtaggcgggtaggtggggtggtggggctggactccgtcacgaccccgaggaaacggccgtggagtcggtcttgctactctatttagtggatgatagagtagcgactacgacgcctatctctagatagaacgacgcctaaccaccaactaccgaaaccgacgaacccgacctaaaccgaaacgtacggtcgtacttaanactacgaaccaagacgtcgaccgtagacgacacacncactaagttactagtacganacagagacgacggtacggacgacggtggtggggttcgggttacgggacggttacgggacggggaccggttaccgggttccgttcgggtaacctccgtccgtaccgacgacccgtcccgttaaccggaaccg

SEQ ID NO: 330573 - DNA, 792 bp, Homo sapiens
  misc_feature: GZ8MTXP01EM2NK.4.75.G09.1.454.CMB.2.raw
  modified_base (619)..(619): a, c, t, g, unknown or other
  misc_feature (619)..(619): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtcgggttcctactacctacgacgtaccgtaacgtacggggtcgggtggggttggggtggggtcgggtcggtacggtaccgttacccggaccgaacccccggaaccccgggaaacggggaacccggtccgggtagggtacgggtcgttacgtacgtacctactttaacgtttaagtttagggtaggagtagtgtaagtaagtaccgcgtacctaaccgaccctactactctacgtagtaacgtaacgaacgccgtaccctaaaccaaccgtaaccaacccgaaaccgggacgaaacccctaaccgtaaaacccgaaacggtacggttacctttaaacaaacgaacgaacctaaacacgtaccggtaccgacgtagaaccgactaacgcaacctaattattacgttacgngaaccaagacgtaacggagtaacggtcggacgtcggtccgggttaaggggttttggggttccggaaccgggttcgggggaacccgggggtaacccgaaacccggggtttcgccggtaaccccggtcgtccctaccgaccggttaccctaacccggttaacccgaacccggggg

SEQ ID NO: 330574 - DNA, 652 bp, Homo sapiens
  misc_feature: GZ8MTXP01BV40H.4.75.G09.1.454.CMB.2.raw
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
tcagagcactgtagcacgaccggtgctcgatttagtatagacatcgagggtcttcgtgactcctgtgccccaccatggacacactttgctccacgctcctgctgctgaccatcccttcatgggtcttgtcccagatcaccttgaaggagtctggtcctacgctggtagaaacccatttacagaccctcacgctgacctgcaccttctctgggttctcactcagcactagcggagtgggtgtgggctggactccgtcacgccccaggaacggccctggagtggcttgcactctatttagtggatgatgactaagcgactacagcccatctctcgatagaacnggctacaaccntaccaaccgaagggaccacctaaccaaaaaaccncgggtcgtaccttaacaatacgaacccaaacgtacgtacgtaccgtacgacgaccaacgacgacctaacgtaacttaacgttacgtcgtacgacgaacgaacggaacggaacggtaacgggtacgacggtcggtaacgggttacggggtttacggggtaccgggttacgggtacgggggtaccgggaaccgggttacccggttaccggtaacccgtacccgtaacccgtcccgtaccgttaccgtaacccgttaaccccgaacccg

SEQ ID NO: 330575 - DNA, 693 bp, Homo sapiens
  misc_feature: GZ8MTXP01C3YUQ.4.75.G09.1.454.CMB.2.raw
  modified_base (311)..(311): a, c, t, g, unknown or other
  misc_feature (311)..(311): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcagctgctcgtaggaagtaattaaaggttgggggaataaggtattggtttgttggtatcagcagaacgccaggccagtcccctgtgcgtggtctattctattanagtactaaccgagccgcctcgacgggtaccctcccgagacgtcgtattctcgtcggtacctaccgaaaccgtcgtacggggaaacctacgacgccctaacttcgacgaacacgtaccggacggtacccgggaacccagggtaccttaagtacgggaagtcgggtacgggtacgttacggtaactttaacgttacggttcgttacccggaggggtaccgggtacgggaactacggccgaaacggtaacccgtaaccctttacccgttaagttcccggtttccggtaaccgttccggttacggttaacccggggtaacccgaaacgggttccccgttaaacccggtccgtttaaaccgggtcccgaaccggtaaaccccccggg

SEQ ID NO: 330576 - DNA, 656 bp, Homo sapiens
  misc_feature: GZ8MTXP01CV215.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggactccgtcacgaccccaggaaacggccgtggagtggcttgcactctatttagtggatgatagataagcgactacacgaccctatctctagatagaacgacggctaaccaccaactaccaaaccgaaacggaccgacctaaccgaaaaccgtacggtacgttacctaacaatacgaaccaaacacgtacgggtaccctaggacgaaacacaacgaccaactaattaacttaaccgtggtacacgaacgagtaaacggacgtacggggacacggcgtaacgggtttcggggttggggtaccttaaccgggttacgggggacccgttaaaccggggttaccccgttcgggtaaccctaaccccggtcctttaaccccgcgttaacccggtccccgttaaccccgtaaaccccggg

SEQ ID NO: 330577 - DNA, 742 bp, Homo sapiens
  misc_feature: GZ8MTXP01DKNGS.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaacggccctggagtggcttgcactctatttagtggatgatgataagcgctacacgccatctctagatagaacgacgctaaccaaccaactaccgaaacccgaaacgggacccgacccctaacccgaaaaaccgtacgggttacgttaacccttaaacaaacgttacgaaacccaaacgtacgttacgggaccccttagggacggaaccaacgacgacccaaacgtaactttaactttaaccgtagttacggacccaaacgaagggtaacgaaacgttaccggggggaccaacgggtcccggttaaacgggggttttcggggggttttaccgggggtacccgtttaaaccggggttcccgggggggaaccccgttaaaccggggggttaaacccccttcgggggttaaccccaaccccgggtttccccgttaccccttaccggaaccgtaaccccccgttaaccccgaaaaacccccggggg

SEQ ID NO: 330578 - DNA, 709 bp, Homo sapiens
  misc_feature: GZ8MTXP01AQKV2.4.75.G09.1.454.CMB.2.raw
  modified_base (333)..(333): a, c, t, g, unknown or other
  misc_feature (333)..(333): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaaaggccctggagtggctgcactctatttagtggatgatgatagcgctacagcccatctctgatagaacnggctacaccaactaccaacccgaaacgggacccgaccctaacccgaaaaaccgtacgggttacggtacccttaacaaatccgaaaccaacgacgtacgggaccccttaggacgggaccaacgaacgtacccaacgtaacttaacgtttaccgtggtacggacccaaaccgaagggtaaacggaacggttaacccgggggacaaacgggtccggtaacccgggttttggggggttttaccgggggaccttaaccgggggttcggggggaacccccgaaacggggggttaaaccccttcgggggttaacccctaaccccgggttcccttaccccggtacccgacccgggtcccccttaaccccggtaaaacccccggg

SEQ ID NO: 330579 - DNA, 673 bp, Homo sapiens
  misc_feature: GZ8MTXP01CQBEC.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctcgacctgcacctttctcgttgggttctcactcagcactagcggaggtgggtgtgggctggatccgtcacgcccccgaaggaaacggcccgtggagtggcttgcacttctatttagtggatgatgatagcgactacacgcccatctcgtcgatacgaacacggcctaaccaccaactaccgaaacccgaaacgggacccgaccctaacccgaaaaaccgtacgggttaccggttaacccttaactaaacgtacgaaaccctaaacacgttacggacccctaggtacggaaccacacgacccaacgtaacttaacttacgtagtcgaccaagagacggacgtaccggcaaggtcgtaaccgggttgggtttaccggggacgttaccggggtacggggacccgttaaccggggttaacccgttcggggttaacccacccggtttccctcccgtacgttacccgtccccgttaaccccgaaccccggg

SEQ ID NO: 330580 - DNA, 662 bp, Homo sapiens
  misc_feature: GZ8MTXP01BDEUH.4.75.G09.1.454.CMB.2.raw
  modified_base (324)..(324): a, c, t, g, unknown or other
  misc_feature (324)..(324): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcactagcggaggtgggtgtgggctggactccgtcacgcccccgaaggaaacggccctgggagtcggcttgcacttctatttagttggatgatgatagcgctacncgccatctctgatagaacgaggcctaaccaccaagtaccaaacccgaaacgggaccccgaacccttaaacccgaaaaaccggtacgggttaccggttaccttaacaaagtacgaaaccctaaacacgttacggtaaccccgttggacggaaccacaacgaccccaagtaacttacttaaccgtggtacgaccagtaaggaacgacggtaccgggacgacggtacgtaacggggttcggggtttacggggaccgttacgggtcgggggacccgaacggggttacccgttcggtcccgtacccggtcctcccgtcaccgtccccgttccgaaaccccggg

SEQ ID NO: 330581 - DNA, 713 bp, Homo sapiens
  misc_feature: GZ8MTXP01EHSP1.4.75.G09.1.454.CMB.2.raw
  modified_base (250)..(250): a, c, t, g, unknown or other
  misc_feature (250)..(250): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtaggagtataaagtggggatagtatgttgtgtancagcagaagccaggccacgtccctgtgctggtctatctattatcgaataccaagccgcctagacggtacctcccgtagacgcgtacttccgtctcgggtacctacccgtaaacgtccgtacggggaaaccacgaccgtaccctaacttccacggaaccctagtacccggaaaccggggccccggggaaacccagggtacttaaacgggtagggtaacgtacgggtacgggggtacttaacggttaacgtttaacgttaccggtcgggtacggtacggggtacgggtacgggaaccgacggtaccgtaaccgtaacccgttacccgttacccgttacgttccgggttacccggttaccgggaccggttaaccggggttaaccgggtaaaccccggttaaaccgggttccccgtaaacccgggttacccggttaaccgggtaaccccgaacccgggtaacccccg

SEQ ID NO: 330582 - DNA, 722 bp, Homo sapiens
  misc_feature: GZ8MTXP01B83JF.4.75.G09.1.454.CMB.2.raw
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacaacacgaccctcacgctgacctcgcctaccttctctgggttctcactcagcacgtaggcgggaggtggggtggtgggctggactccgtcacgaccccgaaggaacggcctggagtggctgctactntatttgtggatgangaatagcactacacgcctatctctcgagtacgaacgacgtaccaccaaccaacgtaccgaaacccggaaacgggtaaccctaaccccgtaaacccgtaaaaccggtacgggttaccgtttaaacccgttaacgtaaactaccgaaacccgaaactaacgggtaccggtaacccgttaggaaccggaaccaacggaaccgaacccgttaaacgttacttaaacgtttcgttaacggtccgaacgaacggaagtaacggaaccgttaccggggactaggtcccgttaagggggtttgggttccgggggtaccgttacggggtaccgggtacccgggttaaccgggttccggttaccgtccgtacccggttcccgaaccttcgaccgttccccgaacccgggaacccgg

SEQ ID NO: 330583 - DNA, 619 bp, Homo sapiens
  misc_feature: GZ8MTXP01DRWRR.4.75.G09.1.454.CMB.2.raw
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctggttctcactcagcactagcggaggtgggtgtgggctggactccgtcacgaccccgaggaaacggcccgtggagtggcttgcactctagtttagtggatgatagatagcgctacacgccatctctcgatagaacgacggcctaacccaacccaactaccaacccgaaaaccggaccgaaccccgtaacccgaaaaacccggtaggttaccggtacccttaacgaactacgaccaaanacgtcgggaccctggtacgacaacgtacgacctaagtacttaattaacctgtanacgacgagaagtacgtacgggcaaggcgtaacgggttgggttaggggaccgttacggcggggaccgacgggttacccgttcggtcctaccgtcttccgcttacgcccttaaccgaacccgg

SEQ ID NO: 330584 - DNA, 549 bp, Homo sapiens
  misc_feature: GZ8MTXP01CD2B2.4.75.G09.1.454.CMB.2.raw
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (531)..(531): a, c, t, g, unknown or other
  misc_feature (531)..(531): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtccagatcacttgaaggagtctggtcctacgctggtacgaaacccacacacgaccctcacgctgacctgctaccttctcttcgggttctcactcagcactagcggaggtgggtgtgggctggatcgcacgccccaggaacggcctggagtgcttgcatctattagtggatgatagataacgcgactacgacnccatctctnatagaacagactacaaccntacaacgaaacgtaccacctaaacgaaacaggtacgtactaanaancgaacaanagtacgacctgaacgacacagaccataagttatactggcacaagngaaagctaccggggatagcggtaaggttacggttcgggacacgggtcggggacaacggggttaccttcggtccacctcgtcccgnaccgtcccaaccgaaccg

SEQ ID NO: 330585 - DNA, 677 bp, Homo sapiens
  misc_feature: GZ8MTXP01AWZ03.4.75.G09.1.454.CMB.2.raw
  modified_base (339)..(339): a, c, t, g, unknown or other
  misc_feature (339)..(339): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggggtgtgggctggactccgtcacgcccccgaggaacggcccgtggagtggcttgcactctatttagtggatgatgatagcgactacacgccatctctagatagaacncgcctaaccaaccaactaccaaccgaaacggaccgaccctaaccgaaaacgtggtacgtacctaacaactacgaaccaacgagtccgacccgttagcggaaccaccgaacgaccctaaactaacgtttaactttaaccggtacgtacgaaccgaaacggaaggtaaacggtaacggtaaccgggacgtacgggtaccgggttaacggggtttcgggggtttacggggaccggttaccggggtaccgggggtaacccggttaacccggggttacccgttccgggtaacccgtacccggttcctacccgtaccgacccgtccccgttaacccggaacccg

SEQ ID NO: 330586 - DNA, 728 bp, Homo sapiens
  misc_feature: GZ8MTXP01A2ASL.4.75.G09.1.454.CMB.2.raw
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (515)..(515): a, c, t, g, unknown or other
  misc_feature (515)..(515): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctcgacctgccaccttctcgtggttctcactcagcacgtagcgggtaggtggggtgtgggctggactccgtcgaccgaccccgaaggaaacggcccgtggagtggcttgctacttctatttagtggatgatagataacgcgactacgacgccctatctcgtagactagaacncgctaaccgaaccnctaccaaccgaaacggacccgacccgtaaaccgaaaacgtaggttaccgttaccttaaacaaacgtacgaaacccaacgtacgtacggacccttaggacgaaccaccgaacgaccctaagtaaactttacgtttaaccgnggttaccgaaccgaacggaacggaaacggtaccggtaaccggggacgtaacgggtccggttaacgggggtttcggggttacgggggtacccgttaacgggggtacccgggggtaacccgttaacccggggttcccgttacgggttaaccccgtaacccgttcccgttccccgtacccggttacccgtccccgttaaccccgaaacccccgggg

SEQ ID NO: 330587 - DNA, 740 bp, Homo sapiens
  misc_feature: GZ8MTXP01EJBIM.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctgggttctcactcagcacgtaggcgggtaggtgggtgtgggcgtggactccgtcacgccccgaaggaacggccgtggagtggctgcgactctatttagtggtatgatagagtaagccgactacacgacctatctcgtacgacgtacgaaacgacggacctaaccaaccctaactaccgaaacccgaaacggaaccctaacccgtaaacccgaaaacgtacgggtaccggttaaccttaacaaacgtacggaaacctaacgtaacgtaccgggttaccctggaacggaccaacaacgtacccaacggttaattacgttaccgttgacgaacccgaagaaggaaacggtacgttaaccgggacgtacgggaacccgggtttaagggggtttcgggggttacgggggtacctttaaacccgggggtcgggggtaaccccgggaacgggggttaaccccgttccgggtaaccccggttacccgggttccttcccccgacgttacccggtcccccgttaacccggaaacccccgggg

SEQ ID NO: 330588 - DNA, 673 bp, Homo sapiens
  misc_feature: GZ8MTXP01CTWRF.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgttccttgcttactgcacaggatccgtggcctcctatgagctgacctcacgcccaccctcagtcgtcccgtcgtccccaggacagacagccagcatcagctgcttcgtagggaagtaagttaaaggttggggggtaaattaaaggttagtttggttttaggttggtatcgagaccgaagaacgcccgacggccctacgttccccgtggtcgccgttggtctagttacttaattacgtacgtaactaccgaacggcccggtacccgtacgaggggtaccccctcccggtaggcgtacgtactttccgtcgtcggtaccctacccgtaaacttccggagggaaaccctacgaccgtaccctactccgacgaacctacgaccggacgggaccccgggaacctagggacttaagcggagtcggaacggggtctaaggtacttagttacgtggacgtaggtacggaggacaggacacgcctaccgttaccgttgttccgttacgtcggacgcgttacgggaacctacggtccctccggtacgttcgtaaccgaaccgaaccccg

SEQ ID NO: 330589 - DNA, 643 bp, Homo sapiens
  misc_feature: GZ8MTXP01CFOY5.4.75.G09.1.454.CMB.2.raw
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgcaccagatcaccttgaaggagtctggtcctacgctggtacgaaacccacacacgaccctcacgctgacctgcctaccttctcgtggttcncactcagcacgtaggcgggaggtggggtgtgggctggactccgcacgccccgaggaacggccgtggagtggctgctactntagtttagtgggatagatagatagcgactacacgcctatctcctagatacgaacgacggacctaccaaccaactaccgaaaccgaacggaccgtacccctaaaccgaaaaccgtggttacgtaaccttaaacgaacgtacaacccaatacgtacggtacccgtaggacgaacacgacgacctaacgtattactacgtgacgacgacgaagacggtaagtaccggacaggtaaccggtaggggtttcggggtacggggcgttaaccgggcggggttaccccggacgggttaccccgtcggacccgtaaccgtcccgttaccaccgtccggttaacccctaacccggg

SEQ ID NO: 330590 - DNA, 613 bp, Homo sapiens
  misc_feature: GZ8MTXP01CHYXL.4.75.G09.1.454.CMB.2.raw
  modified_base (171)..(171): a, c, t, g, unknown or other
  misc_feature (171)..(171): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtccccaggacagacagccagcatcagctgctcgtaggagtaagttaaaggtgggggtaataagttattggtttgttggtatcagcgaagaacgcgacggcctacgtcccctgtgctggtcattcttatntacgactaccgacggtccgaccctagacggtacccctccgngacgtcgtacttcctcgtggtaccctaccgaacgttcgacgggaacacacgccctatccgacgacctacgcgacggccggacctggactagtagggatacggacggggtctacggtaacttacgttaccgtgggtacgtacgggacggtagggaccagccgacgtctaacccttcggttacgttcgtccggttcggaccgttcggttacgggaaccgtcggtaaccgaccggtcgttacggtaaccgcccgtaaccccgg

SEQ ID NO: 330591 - DNA, 612 bp, Homo sapiens
  misc_feature: GZ8MTXP01AZ85S.4.75.G09.1.454.CMB.2.raw
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
  modified_base (506)..(506): a, c, t, g, unknown or other
  misc_feature (506)..(506): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgctaccttctcgtgggttctcactcagcacgtagcggaggtggggtgtgggctggactccgtcacgaccccaggaacggccgtggagtgcttgcactctattagttggatgagtagagtaagcgactacacgccatctctgatagacgagctacaccntaccaaccgaacggaccacccgtaaccaaaaccgtacggttacgtaccttaaanaactaccgaacctaagacgtacgtaccgtagtacgaacacgactaccagtaattacgttatcgtacgaccgaagaaggaagtacgttaaggcgggacgnggtaacccggtagggtttcgggggttgggaccgttacgggcggggaccggacgggttacccgtcggtcctaaccgttccaccgttacgccgttcccgtaaccccgg

SEQ ID NO: 330592 - DNA, 731 bp, Homo sapiens
  misc_feature: GZ8MTXP01DEMRH.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcacttgaaggagtctggtcctacgctggtacgaaacccacacacgaccctcacgctgacctgcctacctttctcgttgggttcctcactcagcacgtagcgggaggtggggtgtgggctggactccgtcaccggacccccgaagggaaacggcccgtgggacgtggtcttcggcctacttctaagttttaggttggggatagaatagtaagtaaggtcccgactaccaccgtcccttaatctacgttagaactaacgaacgacggtacctaacccaacctaacaaccgaaacccgaaaacggacccgaaaccctaaacccgaaaacggtacgggttacctaaccttaacaactacgaaacccgtaaacacggtaccggtacccgtagacggaaaccacggtaacaccccaattaacttacgtttaacacgggacaaccgaagaggaaacggtacgtaccggggactcggtcggtaacggggtttcggggtttaacggggccttacggggtaccgggggaccgttaaccggggttcccttaggggtcccctacccggttcctaacccgcgttacccgcccgttaacccgaacccggg

SEQ ID NO: 330593 - DNA, 559 bp, Homo sapiens
  misc_feature: GZ8MTXP01DMPUT.4.75.G09.1.454.CMB.2.raw
  modified_base (343)..(343): a, c, t, g, unknown or other
  misc_feature (343)..(343): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggccctggagtggcttgcactctatttagtggatgatgataagcgctacagcccatctctgatgaacagctaacaccntcaccaagacgacctaccaaaacaggtcgtaccttaacaatcgaccaacgatcggaccctagtcggaaccactaagccccaagtattaagttaaccgtgtgacacgaagaacgagttacggggacagcgtaacggttgggtttcgggggcttacgtcggggcccgaacgggacccttggtaaccaccgtctcccgtccagtcccttccgaacccgg

SEQ ID NO: 330594 - DNA, 715 bp, Homo sapiens
  misc_feature: GZ8MTXP01DT1Y2.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctcgctaccttctcgttggttcctcactcacgcacgtaggcgggtaggtggggtggtgggctggactccgtcgacgaccccgaagggaacggcccgtggagtgctgctactctagtttagtggatcgatagagtaagcgactacgacgccctagtctacgtagatacgaacgacggtacctaaccaacctaacgtaaccaaacccgaaacgggacccgtaaccccgtaaacccgaaaaacgtacgggttacgtaaccttaacgaacgtacaaccaacgtacgtacgtacctggacgacaactacgaaccaatattacttagtaggcaacgacgaaggaagacggacggtacgacggtcggttaaggggtttcggggttacggggtacccgttaacggggtacccgggggtaaccccgttaaaccgggggttaccccgttaccgggtaaccccgttaaccccggttcccttaccccgtaccgaccccggtcccccgttaaccccggtaaaacccccgggg

SEQ ID NO: 330595 - DNA, 655 bp, Homo sapiens
  misc_feature: GZ8MTXP01DLSO2.4.75.G09.1.454.CMB.2.raw
  modified_base (528)..(528): a, c, t, g, unknown or other
  misc_feature (528)..(528): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgctacctttctcttgggttcctcactcagcacgtagcgggaggtggggtgtggggcgtggatccgtcacgccccgaggaaacggcccgtggagtggcttgctactctatttagttggatgatagagtaacgcgactacacgccctatctctgatagaacgacgcctaaccaccaactaccgaaaccgaacgggaacccgaacccctaaacccgaaaaaccgtacgggttaccgttaacccttaaacgaacgtacgaaacctaactacgtacggtaccctaggacgacaccagaccaactattactacgtgtacacacgagagacgtacggganacggcggtcgggtttgggttcggggtacgttacgggtacggggacccgttaaccggggttacccttcgggttccctaacccggtcccttcccggcttaccggtccccgttaacccgaaaccccgggg

SEQ ID NO: 330596 - DNA, 780 bp, Homo sapiens
  misc_feature: GZ8MTXP01DH2GR.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtagggaagtaagttaaaggttggggggtaaattaaaggttagtttggttttaggttaggtatcgaaggacaaggaaacgccgaggccctacggttccccctggtcgtcgttggtcctaattcttaatttagtacgtaaacttaaccgaacggcccggtcccctaggacggggtacctccccgtaggacgtccggtacttcccgtacgttcgggaccctacccgaaacgttcggtacggggaaaccacgacgaccctacctctacggaacctacgtaccggaacggggtcccggggaaaccccgtagggtaccttaacgggtagggtaacgtacggggtacgggggttaccttaggttaaacctttaacgtttacgtggtacccggtagggggtaccggtagggggaacctacggacgacggtaaccctaacccgttccgttaacgttccggtttacccggttaccgggacccgttaccgggttaacgggggaaaccccgttaaaccgggttccccgtaacccggtcccgggttaaacggtccccgaacccggtaacccccccgg

SEQ ID NO: 330597 - DNA, 584 bp, Homo sapiens
  misc_feature: GZ8MTXP01EU0AD.4.75.G09.1.454.CMB.2.raw
tcagagcactgtagcacgaccggtgctcgatttagtatagacatcagggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtaggagtaagtaaaggttgggggaattaaggtattggtttgttggtatcagacagaagccgaggccacgtcccctgtgctgtcatactattatgataccagccgcctcgaggactcctgagcgtacttctctcggtcctacctaacgtcgtacgggaacacacgcccaactctacgaccatcgaacggccgggtaacccaggtactagtggaagttggacggggtcttaggtaacttacgttacgtgtcggaggacgggtgggaacacgcaagcctaaccttcccgtagttgtccgttcgggcgttaccgttacgggggaaccaaggttccgtaacccggtcgttacgggtccgaacggaacccccg

SEQ ID NO: 330598 - DNA, 668 bp, Homo sapiens
  misc_feature: GZ8MTXP01DYCQB.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctgggttctcactcagcacgtaggcgggtaggtggggtggtggggctggactccgtcacgccccgaagggaacggccgtggagtggctgcactctatttagtggatgatgatagcgctacacgcctatctctagatacgaacgagcctaaccaaccaactaccgaaacccgaaacgggaccgtaacccctaaacccgtaaaaaccgtacgggttaccgttacccttaaacaacgttacgaaaccctaaacgacgttaccggaccgttggacggaccaacgacgaccctaacgtattaacttacgtgtacgacacgagaacgacgtacgggactacgtcggtaagggtttcggggttcggggccggttacgggtaccgggggaccgttaaccggggttacccgttcgggtaacccgtacccgtccttccgaccgaccgtccccgttaacccgaaaccccggg

SEQ ID NO: 330599 - DNA, 647 bp, Homo sapiens
  misc_feature: GZ8MTXP01AQUZV.4.75.G09.1.454.CMB.2.raw
  modified_base (117)..(117): a, c, t, g, unknown or other
  misc_feature (117)..(117): n is a, c, g, or t
tcagagcactgtagcacgaccggtgctcgatttagtatagacatcagggtcttcgtgactcctgtgccccaccatggacacactttgctccacgctcctgctgctgaccatcccttnatgggtcttgtcccagatcaccttgaaggagtctggtcctacgctggtacgaaacccacacacgaccctcacgctgacctgcctaccttctcttgggttctcactcagcacgtagcgggtaggtggggtggtgggctggactccgtcgacgccccgaaggaacggccgtggagtgctgctactctatttagtggtatgatagatagcgtactacgacgccctatctctagatagaacgacgtccaaccaccaacgtaccgaaaccgaacggaccacctaaccgaaaacgtacggtacgtacctaacaacgtacgaaccacgacgtacgaccgtcgtacgacacacgaccaacgtacttaattacgtcgtcgacaacgacggagaacgacggttttacgacggtccggtaacgggttgggttacggggtacggttacgggtaccggggtaccggttaccgggttacccgttaccggtaacccgtacccgttccgtcccgtccgacccgtccccgttaacccgtaaccccgg

SEQ ID NO: 330600 - DNA, 679 bp, Homo sapiens
  misc_feature: GZ8MTXP01EZJUZ.4.75.G09.1.454.CMB.2.raw
  modified_base (427)..(427): a, c, t, g, unknown or other
  misc_feature (427)..(427): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcctaccttctcgtggttctcactcagcacgtagcggaggtgggtgtgggctgatccgtcacgccccaggaacgcctggagtgctgcactctattagttggatgatgaatacgcgactacgacgacctatctctgaagtacgaaacgacgtacctaaccaacccaactacccgaaaccgaaacggacccgtaacctaaacccgaaaacgtacgggttacgtaacccttaaanaacgtacgaaaccctaagtacgtacggaaccctggacgaacacacgacctaacgtaattaacttacgtagacgaacgtaacgaaggagaacggtaaccgggacgtaacgggaccggttaacggggttacggggtttacgggacccggtttaacggggtaccgggggaaccgaaccgggggttaccccttcggggtaacccctaccggttccccttaccgaccggacccgtccccgttaaccggaaccccggg

SEQ ID NO: 330601 - DNA, 653 bp, Homo sapiens
  misc_feature: GZ8MTXP01BAEII.4.75.G09.1.454.CMB.2.raw
  modified_base (483)..(483): a, c, t, g, unknown or other
  misc_feature (483)..(483): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctcgacctgctaccttctcgtgggttctcactcagcacgtaggcgggaggtggggtggtggggcgtgggactccgtcgacggaccccgagggaaacggccgtggagtggctcgcactctatttagtggatgatagagtaagcgactacacgcccatctctgatagaacgacgcctaacacccaactaccgaaccgaaacggaccgaccctaaccgaaaacgtacggtacgtacttaacaagtacaaccaacgagtaccggacctgacgacacgacaccaagtattacgttacgngtacacgacgaggacgtacgcggggacacggtcgtaacggggtttcgggtttacgggggccgttaaccggggtcgggggaacccgttacgggggttaccccgttacgggttaaccccgtccccgttccgttacccctaccggacccgccccgttaacccggaaccccggg

SEQ ID NO: 330602 - DNA, 629 bp, Homo sapiens
  misc_feature: GZ8MTXP01A4WJT.4.75.G09.1.454.CMB.2.raw
  modified_base (351)..(351): a, c, t, g, unknown or other
  misc_feature (351)..(351): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgacccctcacgctgacctgctaccttctctcggttctcactcagcacgtaggcggtagtggggtgtgggctggactccgtcacgccccgaggaacggcccgtggagtggcttgctactctagtttagtgggatgatgatagcgctacacgcccagtctctcgatagaacgnggacctacaccaactaccaaccgaaacgacccgaccgtaacccgaaaacgtggtaccgtaccttaacgaactcgaaaccaacacgtacgacccgtggtacgaccaacacgaccaataacttacttacgtgtacgacgaacgaggtagacgtacgggcctaggtcggtaacgggttggggttcgggccgttacggaccgggggtaccggaacgggttcccgcggggttcccaccggtcccttaccgccgttaccgtccccgttaaccgtaaaccccggg

SEQ ID NO: 330603 - DNA, 625 bp, Homo sapiens
  misc_feature: GZ8MTXP01D4BID.4.75.G09.1.454.CMB.2.raw
  modified_base (361)..(361): a, c, t, g, unknown or other
  misc_feature (361)..(361): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgctaccttctctgggttctcactcagcacgtagcgggtaggtggggtgtggggctggactcccgtcacgcccccgaggaaacggcccgtaggaggtgcttgctactctatttagtggatgatagatagcgactacagccctatctctagatagacgagcctacacnctacaaccgaacggaccacctaaaccgaaacgacgttacgtactaagactacgaaccaacgacgtcgacctagacgactaacacgaccataattacgtacgtgacgaccagtagaacgtacgtaacgggctaacggtcggttaacgggttgggttacggggtcccgttaacgggtcccggggaacccgttaaccgggttcccgttccgggtaaccctcccgttcccgttacccacgttaccgtaaccccgaacgaacccccggg

SEQ ID NO: 330604 - DNA, 559 bp, Homo sapiens
  misc_feature: GZ8MTXP01ENP0I.4.75.G09.1.454.CMB.2.raw
  modified_base (220)..(220): a, c, t, g, unknown or other
  misc_feature (220)..(220): n is a, c, g, or t
  modified_base (248)..(249): a, c, t, g, unknown or other
  misc_feature (248)..(249): n is a, c, g, or t
  modified_base (288)..(288): a, c, t, g, unknown or other
  misc_feature (288)..(288): n is a, c, g, or t
  modified_base (406)..(406): a, c, t, g, unknown or other
  misc_feature (406)..(406): n is a, c, g, or t
  modified_base (473)..(473): a, c, t, g, unknown or other
  misc_feature (473)..(473): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctgtgganataaagtggggataggtattgttgtgannagacagagcagccagtcccctgtgctgtcatctattatnactaccgaagcccgcctcgacgggtctcccgtgagtcgtacttctctggacctccaaaccgttcgaacgggaacacgacgccctattcgacgaccagttaccgagggcccggaacccngggtactaaggtgaagttcggaggggcttaggaacttaccgtatacggtcgaggtcggagggaaccngacgacgtaacctaccgttctcttcgtcgtcggacgttcggacggtaaccgacgtaaccgccgtacgaccgtcgaaccgtaacccg

SEQ ID NO: 330605 - DNA, 672 bp, Homo sapiens
  misc_feature: GZ8MTXP01AMMLW.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcagtagcggagtggggtgtgggctggactccgtcacgccccgaggaacgccgtggagtgcttgctactctattagtggatgatagagtacgcgactacgacgccatctcgtcgatacgaacgcgactaaccacctaacaccgaaaccgaacggaccgaaccctaaccgaaaacgcggttacgtacctacgaacgtaccgaaccaagtaccgtacggtaccctgggtacgaaccacgacgtacccaagtactttaacgtacctcgggtacgccaaacggacggtaacgtacggtacggggcctaacgggtccgtaacggggtttacgggtttcgggggaaccgtttacgggggacccgggggtaccgttaaaccggggttaaccccgttggttaaccccgttaccgtccgttcccgtacgttacccgtaaccccgttaacccgaaacccgggg

SEQ ID NO: 330606 - DNA, 688 bp, Homo sapiens
  misc_feature: GZ8MTXP01BDOEE.4.75.G09.1.454.CMB.2.raw
  modified_base (350)..(350): a, c, t, g, unknown or other
  misc_feature (350)..(350): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctgggttctcactcagcactagcgggagtggggtgtgggctggatccgtcacgccccaggaacggccctggagtggcttgctactctatttagtggatgatgatagccgctacacgccatctctcgatagaacaggctaaccaccntaccaaccaacggaccgaccctaacccgaaaaccgtacggttacgtacccttaaacgaactacgaaacccaacgtacgtacggtaccctaggtacggaaccaacgacgacccaacgtaacttaagttaccgtggtacgaccgaacgaacggtaaacggtacggttaacccgggggactacgggtacccggtaaggggtttcgggggttttacgggggaccgttaccggggtaccggggggcccgttaaccgggggttaaccccgttcgggttaaccccgacccgggtttccctcccgttacccggaccgtcccccgttaacccggtaaacccccgggg

SEQ ID NO: 330607 - DNA, 681 bp, Homo sapiens
  misc_feature: GZ8MTXP01CX18W.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctcgtggttctcactcagcacgtagcggaggtgggtgtgggctggactccgtcacgccccgaaggaacgcccgtaggagtggcttgctactctatttagtggatgatgatagcgctacacgccatctactcgatacgaacgtacggcctaaccaacccaatacccgaaaccgaaacggacctaccctaaaccgaaaacgtacgggtacgtacccttaacaacgtacgaaccaacgtacgtccggtaacccgtggtacggaaccaacgaacgacccaacggttaactttaactttacgtcgtacgaccaaccgaggaacgacgtacgggacacggtccggtaacgggtttcggggttacggggtaccgttacgggtaccgggggaccttaaaccgggggttaccccttcggggtaacccctacccggttccgttaccccgtacgaccgtaacccccgttaacccgtaaacccccgggg

SEQ ID NO: 330608 - DNA, 661 bp, Homo sapiens
  misc_feature: GZ8MTXP01AR65S.4.75.G09.1.454.CMB.2.raw
  modified_base (325)..(325): a, c, t, g, unknown or other
  misc_feature (325)..(325): n is a, c, g, or t
  modified_base (365)..(365): a, c, t, g, unknown or other
  misc_feature (365)..(365): n is a, c, g, or t
  modified_base (459)..(459): a, c, t, g, unknown or other
  misc_feature (459)..(459): n is a, c, g, or t
  modified_base (472)..(472): a, c, t, g, unknown or other
  misc_feature (472)..(472): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggttctcactcagcacgtaggcggtaggtggggtgtggggctggactccgtcacgacccccgaggaaacggccctggagtggcttcgctactctatttagtggatgatgatagcnctacacgcctatctctgatagaacaggcctaaccactaanaccaaaccgaacggacccgtaaccctaaccgaaaaccgtcggtaccgttacctaagaactaccgaacaactacgcgtaccgtgacgacacgacncaatatatacgtncgacaacgtaggaagacgtacgggacacggacggttaacgggttgggttacgggggtaccgttaaccgggtcgggggtaacccgttaaaccggggttaccccgtttacgggaaccccgttaccccgttccccgttaacccgggttacccaccccggtaaccccgttaacccccggtaaaacccccgggg

SEQ ID NO: 330609 - DNA, 607 bp, Homo sapiens
  misc_feature: GZ8MTXP01A9SLH.4.75.G09.1.454.CMB.2.raw
  modified_base (250)..(250): a, c, t, g, unknown or other
  misc_feature (250)..(250): n is a, c, g, or t
  modified_base (376)..(376): a, c, t, g, unknown or other
  misc_feature (376)..(376): n is a, c, g, or t
  modified_base (460)..(460): a, c, t, g, unknown or other
  misc_feature (460)..(460): n is a, c, g, or t
  modified_base (491)..(491): a, c, t, g, unknown or other
  misc_feature (491)..(491): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtgcctcctatgagctgactcacgccaccctcagtcgtccgtcgtccccaggacagacagccagcatcagctgctcgtaggaagtaagttaaaggttgggggaataaggttnttggtttgttaggtatcgagtacaaggaacgccgacggccacgtcccctgtcgcttggtctattcttattatagaactaccgaagccggccctagacgggtacctcccgtagacgtcgtactttcncgtcggcctacccaactacgtacgggaacacgacgacccattcctacgacctagtcgaaccggccgggtacccagggacctagnggactagggacggtcgtagtactagttacgngtacgagggccgtagggacagccaaggtccaacttccctagttcgtaccgtcggacgttccggttacggaacctacggtcccgtacgtaccgttacggaacccaaccggaaccccg

SEQ ID NO: 330610 - DNA, 837 bp, Homo sapiens
  misc_feature: GZ8MTXP01CW2OH.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgtgggttcctcactcagcacgtagcgggaggttggggtgtgggctggactcccgtcacgccccgaggaaacggcccgtggagtggcttgctactctagttagtggatgatagagtaagccgtactacgacgtcccctaatcctctacgtaacgtacgaacgtacggtaccttaaaccccgaaccaaccgttaacccgaaaaccccggtaaaccgggtaacccccgtaaaccccctaaaaccccgtaaaaaaacccgggtacgggtttaacccgggtttaaccccttaaaaccgtaaaccggttaaccgaaaccccgaaaaccgtacgggttaaccccggtaaccccgtttacgggaaccgtaaacccgaacggttaaacccgaacccgtaaacttaaacgttaaaccgtttaaccgtacgggttaacgacccgtaaaccgagggtaaaacgtaccggtaaaccgggaccgaacgtaccggggttaacgggtttcgggggttttacggggacccggtttaacgggtacccgggggtacccggaaacggggttaacccccgttcgggtaacccctacccgggttaacctcccgtaccgttacccgtaaccccgttaaccgaaaccccggg

SEQ ID NO: 330611 - DNA, 715 bp, Homo sapiens
  misc_feature: GZ8MTXP01AHJEK.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacagaccctcacgctgacctgctaccttctctgggttctcactcagcacgtagcgggaggtggggtggtgggctggactccgtcacgccccgaggaacggccgtggagtggctgctactctatttagtggatgatgatagcgctacacgccatctctgatagaacgacggcctaaccgaacctaactaccgaaacccgaaacgggacccgtacccttaaacccgaaaaaccgtacgggtaccgttaaccctaacgaacgtaaccggaacctaaacgtacgtaccggtaccccgttgggaaccggaaccaaccgaccgtaccctaacgttaaactttacgtttaaccgtcggtacgaccgaacgaagggaacggtaacggtaccgggacgtaacgggtccggttaagggggttcgggggtttcggggtacccggttacggggtccgggggacccgttaacgggggttaccccgttcgggtaaccccgtcccgttcccgttcccgtaccggaacccgtcccgttaaccccggaaacccgggg

SEQ ID NO: 330612 - DNA, 653 bp, Homo sapiens
  misc_feature: GZ8MTXP01ALT8R.4.75.G09.1.454.CMB.2.raw
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (622)..(622): a, c, t, g, unknown or other
  misc_feature (622)..(622): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggttctcactcagcacgtaggcggtaggtgggtgtgggctggactccgtcaccgaccccgaggaacgccgtggagtcggctgcacttctagtttacgtggatgatagaatacgcgactacacgccctatctctagacgtagaacgtaggcctaaccgaacctctacccaaacccggtaacgggacccctaaccaaaccgaaaacgtacgggttaccgttaaccttaagaaactcgaaacctacgaacgttcggaccctgacgacacacgtacactattacgttaccngtacncaagngaacgacgtaccgggatacggtcgtcggggttaggggttcgggaaccgtttacggggaacggggtccccgttaaaaggggttcccccttgtaaccccgggtcccttcgtaccccncggttaccgcccccgttaacgggaaaccccg

SEQ ID NO: 330613 - DNA, 690 bp, Homo sapiens
  misc_feature: GZ8MTXP01EG9TC.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgtggttcctcactcagcacgtagcgggtaggtggggtgtgggctggactccgcaccgaccccgagggaacggccgtggagtcggtcttcgacctacttcgttaagtttagttaggggtattaggtaatagtaataaacggcccgtacctaaccgacgtccctaatccgttatacgagtacgaaacgacggtaccctaaacccaaccctaactacccgaaacccggaaaccggacccgtaaccctaaaaccgaaaaaccgtcgggttaccgtaaccttaacaagtaccgaaccaacgtacgtacgtaccgtgacgaaccacgacacctaagtacttacttacgtgacgacaacgtagaacgtacgtacggcacggtcggtaacgggttgggtttcgggacttacgggcggggaccgttaacggggttcccttaggtccctacccgtcctccgtacacccggtaaccttaaccccggaaccgg

SEQ ID NO: 330614 - DNA, 689 bp, Homo sapiens
  misc_feature: GZ8MTXP01BB0EI.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgctaccttctcgtggttctcactcagcacgtagcggaggtggggtggtgggcgtggactccgtcgacgccccgaggaacggccgtggagtgctgctactctatttagtggatgatagatagcgactacgacgcctatctcgtagagtacgacgacgctaaccgactaactaccgaaaccgaacggaccaccgtaaaccgaaaacgtacggtaccgtactaacaagtaccgaaccaagacgtacggtaccgtgacgaccacgacgaccaacgtaattaacgttactggtacaccgaaagacggtaaacgtacggtaccgggacgtaaccgggtcggttaacggggttgggggtttaccggggtccggttaacggggttccgggggaacccggttaacccggggttaccccggttaccgggttaaccccgtcccggttccccgttccccgacccggacccgttaacccccgaaccccggtaaacccccggggg

SEQ ID NO: 330615 - DNA, 715 bp, Homo sapiens
  misc_feature: GZ8MTXP01BHY33.4.75.G09.1.454.CMB.2.raw
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcaccgctcgacctgctaccttctcgtgggttctcactcagcacgtaggcggtaggtggggtgtgggctggatccgtcgacgaccccgaggaacggcccgtgggagtggcttcgctacttctaatttagttgggatgaatgaacgtaagccgctacgacgcccatctctagatagaacnggcctaacaaccnctacaaacccgaaacggacccaacccgtaaaccaaaaacgtacggttacgtaccttaacaaactacgaacccaacacggtacgaccgtacggacggacaccgtacgacccaacgtaattaacgttaaccgtgacgaccaacggaagaacgtaacggtacccggggatacggtccggtaacggggtttcggggtttaccgggggaccgtttaaacgggggtccgggggaaacccccggttaaccgggggttaacccgttccgggggttccccttaaccggggttcccctccccgtttaccggacccgaaccccggttaaccccggtaaaaccccggggg

SEQ ID NO: 330616 - DNA, 534 bp, Homo sapiens
  misc_feature: GZ8MTXP01C163Q.4.75.G09.1.454.CMB.2.raw
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctgggtagaaaacccacacagaccctcacgctgacctgcaccttctctggttctcactcagcactaggcggaggtggggtgtggggctggactccgtcacgccccgaaggaaacggcccgtggagtggcttcgctactctatttagtggatgatgataagcactacgaccncatctntacganagacacgcaacacncacaacgaacgacaaccaacaaacgngtactactaanactacaacagacgtacgacagacgacacactacagtatatgnacanagagagacgtcggagagngtaagggtgggttacggcgttcgggacgggacgacggccgttcgtcctacgtctccgcaccgtccgaaccgaaccg

SEQ ID NO: 330617 - DNA, 651 bp, Homo sapiens
  misc_feature: GZ8MTXP01ACOMQ.4.75.G09.1.454.CMB.2.raw
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
  modified_base (618)..(618): a, c, t, g, unknown or other
  misc_feature (618)..(618): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggttctcactcagcacgtagcggtaggtgggtgtgggctggactccgtcacgccccgaaggaacggtccgtggagtggtcttcgctacttctagtttagtggatgatgatacgcgtctacacgtcctatctactgatagaacgacgcctaccaccnctaccgaaacccgaacggaccaccctaaaccgaaaaccgtcggtaccgttaaccttaanaacgttaaccgaacctaacgtacgttaccggaccgtgtaaccggaccacgtacacctaagtagttaactcgtacgacgacaacgaggtacgacggtccgggacacggtccggttaaggggtcgggtttcggggaccgttacggggtccgggaaccggttaccggacccgttccggtaaccgtacccgtccncccgtacgacccggtccccaacgtaaccccggg

SEQ ID NO: 330618 - DNA, 704 bp, Homo sapiens
  misc_feature: GZ8MTXP01BZEX8.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctcgctaccttctcgttggttctcactcagcacgtaggcgggtaggtggggtggtggggctggactccgtcaccggaccccgaagggaacggccgtggagtggctgcactcgtatttagtggatgtagtagaagtagcgactaacgcgcctatctctagactagaacgcggctaaccaccaactaccgaacccggaaaccggaccccgtaacccgtaaacccgaaaaccggtacgggttaccggtacccttaaacgtaaacgtacgaaacccgtaaacgtacgtaccgggtacccgtggtaacgaccaacgacgaccctaagtaactttaacgttactcgtacgacaacgacggaaggaccgtacggacgtacggtcggtaacggggtttgggttacgggggtaccgttacggggtaccggggtaaccggttaccgggttacccgttcgggtcccgtacccgtcccgttacccgccgttacccgtccccgttaacccgtaaccccgggg

SEQ ID NO: 330619 - DNA, 668 bp, Homo sapiens
  misc_feature: GZ8MTXP01AC4W2.4.75.G09.1.454.CMB.2.raw
  modified_base (509)..(509): a, c, t, g, unknown or other
  misc_feature (509)..(509): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctaggtacgaaacccacacacgaccctcacgctcgacctgcctaccttctcgttcgggttctcactcagcaacgtaggcgggtagggtggggtgtgggcgtggactccgtcgaccgacccgaaggaacggccgtggagtggtctgactactacgtagtttagtggatcgtagtagagtaacgcgactacgacgcctatcgtacgtagagtacgaacgagacctaaccacctaacacgaaaccgaacgaccctaaccgtaaaccaaacgtacgggttactaacctaacggaactacgacccaaagtcggaccgtactggacaacgacacgacctaagtattacgttacgngtacgaccaaaggaggtaaacggaccggtcggactacgggtacggttaacgggttgggggttacccgggacgttccgggggacgggaacccgaccgggttccgttcccggctacccgtcgtcccaacggttaccctaacccgaacccggtaaccccggg

SEQ ID NO: 330620 - DNA, 680 bp, Homo sapiens
  misc_feature: GZ8MTXP01C7RYQ.4.75.G09.1.454.CMB.2.raw
  modified_base (505)..(505): a, c, t, g, unknown or other
  misc_feature (505)..(505): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaacggcctggagtgcttgcactctatttagtggatgatagatagcgctacacgccctatctcgtagatagaacgaggcctaccaaccaactaccgaaaccgaaacggacccgaacccctaaacccgaaaaaaccgtacgggttaccgttaccctttaaacaaactacgaaacccaaacgacgttcgggaaccccttaggacggaaccaacgaaaccgaccaaacgtaattaacgttttaaacgngttacgaccaaacgaggaaacgtacgtaacggggacagggtccgtaacggggtttggggtttacggggccgttaacgggtccgggggaccgttaaccgggggttacccgttcgggttaaccccgaacccgttccgttaccccgccgaccgtccccgttaacccgaaacccccggg

SEQ ID NO: 330621 - DNA, 686 bp, Homo sapiens
  misc_feature: GZ8MTXP01B01VE.4.75.G09.1.454.CMB.2.raw
  modified_base (532)..(532): a, c, t, g, unknown or other
  misc_feature (532)..(532): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctcgcctaccttctcgtgggttcctcactcagacacgtaggcgggtaggtggggtggtgggctggactcccggtcgacgaccccgaaggaacggccgtggagtggctgctacttctagtttagttggatgatagataagcgactacgacgccctatcgtctcgatacgaacgcggcctaaccctacccaactaccgaacccgaaaccgggacccgaaccctaaacccgaaaaccggtacgggttaccggttaaccttaaccgaaactaccggaaacccaacgtaaccgtacggtacccgtaggacgaaccacgaccgaccctaagtacttattacgngtcacgacgagaaggacgtacgggaccgtagcccggtaaggggttcggggttcgggaacgttccgggacggggtacccgacggggttaccccgttcggaaccccgttaccgtcccgttcccgaccgacccgtccccgaacccgtaaccccgggg

SEQ ID NO: 330622 - DNA, 662 bp, Homo sapiens
  misc_feature: GZ8MTXP01EOWGM.4.75.G09.1.454.CMB.2.raw
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (536)..(536): a, c, t, g, unknown or other
  misc_feature (536)..(536): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgacccctcacgctgacctgctaccttctcgtggttctcactcagcacgtgcggagtggggtgtgggctggactccgtcacgaccccgaggaacgccgtggagtggctgctactntagttgtggatagntagataagcgactacacgccatctntacgatagaacgacgtcctaaccaaccaactacccgaaacccgaaacgggaccccgtaaccccgtaaaaccgaaaaccgttacgggtaccgttacttaaacgaactacgaaaccaacgtaacgtaccgggtaccctaggtacgaaccagaccacctaacgtattacttccgagtacacgaacgaggacggtacgtaccggggnacgggtcgtaacgggtttggggttcgggtacgttacgggtcggggtaacccggttacggttaccccggttcggtaacccgcccggttaaccttcccgaccgaccgggtccccaacggaaccccggg

SEQ ID NO: 330623 - DNA, 796 bp, Homo sapiens
  misc_feature: GZ8MTXP01BH57J.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctggttctcactcagcacgtagcggagtgggtgtgggctggactccgcacgaccccgaggaacggccgtggagtcggtctcgactacttactagtttagttagggatgaagttagaacgtaacggccgtactacgacgtaccctaattccgtacgtacgaagtacgaacgtacggaccctaaccaaacccgtaactaacccgaaacccgggaaaccggtaaccccgtaaccccgtaaaccccgtaaaaaaaccggtccgggggtttaaccgttaaccctttaaaacgaaaccggttaaccggaaaccccttaaaacggtaacccggttacccgggtaaacccccgttaggggtaaccgaaacccaaccgaacgtaccccctaaaggttaacttaaacgtttaccgtaggtacgaaccaaaccggaggtaaacggaccgttaccggggactacgggtacccgtaagggggtttcgggttaccggggacgttaccggggtcgggggacccgaaccggggttacccgttcggtaaccccgtacccggttcctaacccggtccgacccgtaacccgttcccggaaaccccggg

SEQ ID NO: 330624 - DNA, 688 bp, Homo sapiens
  misc_feature: GZ8MTXP01A7JL9.4.75.G09.1.454.CMB.2.raw
  modified_base (446)..(446): a, c, t, g, unknown or other
  misc_feature (446)..(446): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacacgaccctcacgctcgacctgcctacctttctcgtgggttcctcactcagcacgtaggcgggtaggtggggtggtggggctggactccgcgaccgaccccgaaggaacggccctggacgtggtcttgcctactcttagtttagtgggtatagatagataagccgactacacgccctatctctacgatagaacgcggcctaacccaccaactaccgaaaccgaaacggacccgtacctaaacccgaaaacggtaggtaccgttacctaanaaacgtacgaacctaaacgacgtacccggtacccgtggacggaaccacgaccgaccctaacgtacttaacgttacgtcgtacgaccacgaagacggtacgtcgggacacggtcgggtgggtacgggggttttgggacccgttacgggaccgggggtaacccggttaaccgggttcccgttacgggtcccgtaccccgttaactccccgtacgaccccggtaacccttcccgtaaccccgggg

SEQ ID NO: 330625 - DNA, 610 bp, Homo sapiens
  misc_feature: GZ8MTXP01E0MFG.4.75.G09.1.454.CMB.2.raw
  modified_base (245)..(245): a, c, t, g, unknown or other
  misc_feature (245)..(245): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataagttggggatagtatgttgtgtatnagcagaagcagcacgccctgtgctgtcatctatatgataccgagcgcctcgacggtacctccgtgagcgtattacctcgtcggtcctaccgaacctcgtacggggaactaccgacgaccctacgtcctacggacccagttaccgacgggaccgggaacccgacgggaccgtaagttagggacgttaggacgggggtcgttacgggtaactttacttaaccggtgttacccggaggggtcggtacgggaccgaagtaccgacggctacccgttccgttacgttggtccgtttacgggccgttacgttccggggtaaaccacggttaacccgacccggtcgttacggtcccgaacccggtaaccccg

SEQ ID NO: 330626 - DNA, 751 bp, Homo sapiens
  misc_feature: GZ8MTXP01AFNRQ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtcgggttctcactcacgcacgtagcgggtaggtgggtgtgggctggactcccgtacgaccgacccccgaagaaacggcccgtggtacggtcggtcgttgacctacttacgtaagttttagtagggattagaatagacgtaagcgtacctaacacgtaccctatctctacgaatacgaacgtaccggcctaaaccaaccgtaactaccgaaacccgaaacggtaaccccgtaacccgtaaacccgaaaaccgtacggggttaccttaaccttaaacgaactaaccgaaccgtaacgtaccggtacggtaccccgtagggaaccgaaccaacgaccgtaaccctaacggtaatttaaccgtttcgaacggttcgaacccgtaaagacgggtaaacggtaacgggtaccgggacgtaacgggtcgggttaacggggttcgggggtttacggggcccttcgggggtaccggggtaacggggacccgttacggttaccggttccgggactccgtccgtaccgcgtaaccgccccgtaaacccggg

SEQ ID NO: 330627 - DNA, 588 bp, Homo sapiens
  misc_feature: GZ8MTXP01AW6XR.4.75.G09.1.454.CMB.2.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgttagtgtancagcagaagccaggccngtcccctgtgctggtcatctatatnataccagtcggcctnagggtactcccgngtagcgattcctctggctccaactctgggaacncacgccactcngaccatcacgcggacccaggctactggactgacggggctaggtcttagtaccgtgtaccgaggtaccgtacggggaccgacgaccgtggcccaaacccgttccccgttaaaccttcgggttacccgtttacccggggaccgttacccgttacgggggtaacccgaaacgggtttcccggaaccccgtttaccccgggttacggtccccgttaacgaacccccccggg

SEQ ID NO: 330628 - DNA, 552 bp, Homo sapiens
  misc_feature: GZ8MTXP01AR8CB.4.75.G09.1.454.CMB.2.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (536)..(536): a, c, t, g, unknown or other
  misc_feature (536)..(536): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctctggttctcactcagcactagcggagtgggtgtgggctggactccgtcacgccccaggaacggcctggagtggcttgctactctatttagtggatgatgataagcgactacncgccatctcngatgaacagctaacaccaataccaaccgaacggaccacctaaaccaaaacgtggtccgtacttacgaatcgaacanacgtcggaaccctggacgacacgacaccagtatattacgngtancacgagagagtcggatacgcgtaagggtggttcgggcttacgggtcgggaccgttacgggaccttcggcctaccgtcctaccgcgttacncccgttccaacccggg

SEQ ID NO: 330629 - DNA, 723 bp, Homo sapiens
  misc_feature: GZ8MTXP01CLYVG.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcttgggttctcactcagcacgtaggcggtaggtggggtgtggggctggactccgtcaccgaccccgaggaacgccgtggagtgcttgctactctattagtggatgatagatacgcgacacacgccctatctcgtagagtagaacgacggtacctaaccgaacctaactaccgaaaccgaaacgggacccctacccgtaaacccgaaaaccgtcggttaccgttaccctaaacaacgtaccgaaccctaaacgacgtacggtacccctggtaccgaacctaaccacgaccaactaacttacgttaccgtcggtacaccgtaaacgaggaaacgtaacggttaaccgggacgtaaacggtccggtaacggggtttggggttaaaccggggtccggttaaccggggtaccgggggtaacccggttaacccgggggttacccttccggggtaacccgtacccgttcccgtaccccggtaccgttaacccggtccccgttaaacccgtaaacccccgggg

SEQ ID NO: 330630 - DNA, 654 bp, Homo sapiens
  misc_feature: GZ8MTXP01A8AJF.4.75.G09.1.454.CMB.2.raw
  modified_base (360)..(360): a, c, t, g, unknown or other
  misc_feature (360)..(360): n is a, c, g, or t
  modified_base (496)..(496): a, c, t, g, unknown or other
  misc_feature (496)..(496): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgctaccttctcgttggttctcactcagctacgtagcgggtaggtggggtgtggggtctggactccgtacgaccgaccccgaggaacggccgtggaggtggcttgcacttactagtttagtggatgatagagtagcgactacacgcctatctcgtagatagaacngcctaaccacctaacacaaccgaacgacccgaacctaaccaaaacgacgggttaccgtaccttaaacgaaactaccgaaacctaacggtacgtaccgggtacctggacgaaccgactacgaccaatattagttacngtacgaccaagagaacgtacgaacgggccaagggtcccgggaagggttttcgggggttaccgggtacgttaccggggttaccggggacccggttaacgggttaccggttccgtaaccgtcccgtcctcgtaccgaccgtaaccgttccgaaacccggg

SEQ ID NO: 330631 - DNA, 474 bp, Homo sapiens
  misc_feature: GZ8MTXP02I5SPX.4.75.G09.1.454.CMB.2.raw
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagacagcatcagctgctctggagataaattggggataagtatgttgtggtatcagcagaagccaggccagtcccctgtgctggtcatctattatgataccaagcgccctnaggactccctgagcgattctctggctcaactctgggaacacagccactctgaccatcagcgggaccaggctatggatgaggctgactattacngtcagggtctgggacagcagcactccctatgtcttcggcactcgggaaccaaggtcaccgtctacggtcacgacccg

SEQ ID NO: 330632 - DNA, 505 bp, Homo sapiens
  misc_feature: GZ8MTXP02JQGWV.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattggggataagtatgttgtggtatcagcagaagccaggccagtcccctgtgctggtcatctattatgataccaagccggccctcgaggacctcccgtgagcgtattctcgtggcctaccaacttcgtagggaacacacgcccactctacgaccatcgacgccgggacccaggctagtggatcggaggctagacttattacgtgtcgaggcgtggacagcagcactccatcgttctcggctacggtacggaaccgaacggtccaccgtctacggtcacgacccg

SEQ ID NO: 330633 - DNA, 470 bp, Homo sapiens
  misc_feature: GZ8MTXP02HL45P.4.75.G09.1.454.CMB.2.raw
  modified_base (303)..(303): a, c, t, g, unknown or other
  misc_feature (303)..(303): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgttgtggtatcagcagaagccaggccagtcccctgtgctggtcatctattatgatacaagcgcctnagggactccctgagcgattctctggcctccaaactctagggaacacagccactctgaccatcagcggacccaggcatggatgaggctgactatactgtcaggcgtgggacagcagcactccctatcgtctcggcacgtggaaccaggtcacgtctacgcacgacccg

SEQ ID NO: 330634 - DNA, 501 bp, Homo sapiens
  misc_feature: GZ8MTXP02GDP0Q.4.75.G09.1.454.CMB.2.raw
  modified_base (342)..(342): a, c, t, g, unknown or other
  misc_feature (342)..(342): n is a, c, g, or t
  modified_base (418)..(418): a, c, t, g, unknown or other
  misc_feature (418)..(418): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcactcatttattgggatgatgataagcgctacagcccatctctgatgaacaggctcaccntcacaaggacgcctaccaaaaccaggtgtccttacaatgaccaacatggaccctgtggacacagccacatattacngtgcacagagatacgggcagcacgtggtttgggctacgtggggccaggggaccctggcaccgtctccgtcacgcctaccaacg

SEQ ID NO: 330635 - DNA, 499 bp, Homo sapiens
  misc_feature: GZ8MTXP02JUAFV.4.75.G09.1.454.CMB.2.raw
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (471)..(471): a, c, t, g, unknown or other
  misc_feature (471)..(471): n is a, c, g, or t
tcagagcactgtagcacgaccggtgctcgatttagtatagacatcagggtcttcgtgactcctgtgcccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaggccctggagtggcttgcactcatttatgggatgatgataagcgctacagcccatctctgatgaacaggctcaccntcaccaaaggaccgcctaccaaaaaccnggtagtccttacaatgaccaacatggaccctgtgacacagccacatatactgtgcacagagatacgggcagcacgtggttgggctacgtggggccagggaacccnggtccacgtctcctcacgcctcaacccg

SEQ ID NO: 330636 - DNA, 669 bp, Homo sapiens
  misc_feature: GZ8MTXP02JYOTD.4.75.G09.1.454.CMB.2.raw
  modified_base (343)..(343): a, c, t, g, unknown or other
  misc_feature (343)..(343): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaacggccctggagtggcttgcactcatttattgggatgatgataagcgctacagcccatctctgatgaacaggctcaccntaccaaccaaacggaccgaccctaacccaaaaaaccgacgggtacggtaccctttaaacaaacttacggaaacccaaaacaacgttcggggaacccccttagggttacgggaaccaaaccacggaccccaaacacttaatttaacctcggttagaccaaaccgaagaaggaacttaccgggggacaaagccgtaacgggttggggttttcgggggacctttaaccgggtcgggggaccccgaacgggggtaaacccccgttggggtaacccgtaaccccgggttccgttcccttaccgaccggaccccttcccgaaaacccccggg

SEQ ID NO: 330637 - DNA, 478 bp, Homo sapiens
  misc_feature: GZ8MTXP02H70NN.4.75.G09.1.454.CMB.2.raw
  modified_base (305)..(305): a, c, t, g, unknown or other
  misc_feature (305)..(305): n is a, c, g, or t
  modified_base (410)..(410): a, c, t, g, unknown or other
  misc_feature (410)..(410): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattggggataagtatgtttgttggtatcagcagaagccaggccagtcccctgtgctggtcatctattatgatacaagcgccctnaggactccctgagcgattctctggctcaactctagggacacagccactctgaccatcagccggaccaggctatgatgaggctgactatactgtcaggcgtggacngcagctacgtccctatcgtcttcggctacgtgggaaccagggtccaccgtactacggtcacgaccccg

SEQ ID NO: 330638 - DNA, 579 bp, Homo sapiens
  misc_feature: GZ8MTXP02G8RR2.4.75.G09.1.454.CMB.2.raw
  modified_base (435)..(435): a, c, t, g, unknown or other
  misc_feature (435)..(435): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccaggaaacggccctggagtggcttgcactcatttatggatgatgataagcgctacagcccatctctgatgaacaggctcaccataccaaccgaaaggaccgaccctaacccaaaaaccgacgggtacgtaccttaacaatacgaaccaacatcggaccctgtacgacacagccaanatatactgtagacacagagacgtacggacagctacggttgggttggggccgtaacggtcgggggtaccgaacgggggtaaccccgtgggtaacccgaacccggtccttacccgtaccgacggtacccccttaccgaaaccccgg

SEQ ID NO: 330639 - DNA, 486 bp, Homo sapiens
  misc_feature: GZ8MTXP02ICRWQ.4.75.G09.1.454.CMB.2.raw
  modified_base (361)..(361): a, c, t, g, unknown or other
  misc_feature (361)..(361): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagtcaccctcagtgtccgtgtccccaggacagacagccagcatcagctgctctggagataaattggggataagtatgtttgtggtatcagcagaagccaggccagtcccctgtgctggtcatctattatgataccaagccggccctcaggggactccctgagcgattctctgggcctccaaactctggggaacacagccanctgaccatcagccgggacccaggctatggaatgaggctgactattactgtcaggcgtgggacagcagcactcctatcgtcttcggctacgtggaaccaaggtccacgtctacggtcacgaccccg

SEQ ID NO: 330640 - DNA, 498 bp, Homo sapiens
  misc_feature: GZ8MTXP02I4TAB.4.75.G09.1.454.CMB.2.raw
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattggggataagtatgttgtggtatcagcagaagccaggccagtcccctgtgctggtcatctattatgatacaagcgcctcgaggacctccctgagcgtattctcgtggcctacccaaactccgtaggggaaaccacgacgcccactctgaccatcagccgggaccnggctagtggatgaggctgactattacgngtcaggcgtggacagcagcactcctatcgtcgttcgctacgtcggaaccgaacggtccaccgtcctacggtccacgaccccg

SEQ ID NO: 330641 - DNA, 513 bp, Homo sapiens
  misc_feature: GZ8MTXP02I1Q8J.4.75.G09.1.454.CMB.2.raw
  modified_base (367)..(367): a, c, t, g, unknown or other
  misc_feature (367)..(367): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcacatcaccaaggaccgcctaccaaaaaccnggtgtccttaacaatcgaccaacatcggaccctgtcgacacagccacattatactgtgcacagagatacgggcagcacggtggtttggggctacgtcggggcctacgggaccctggtcgaccgtctcctcgacgcctaccaacccg

SEQ ID NO: 330642 - DNA, 491 bp, Homo sapiens
  misc_feature: GZ8MTXP02HDP8J.4.75.G09.1.454.CMB.2.raw
  modified_base (413)..(413): a, c, t, g, unknown or other
  misc_feature (413)..(413): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttggggataagtatgttgttggtatcagcagaagccaggccagtcccctgtgctggtcatctattatgatacaagcgcctcaggactccctgagcgattctctggctccaactcgtaggggaacacacgcccactcctagacccatcgacggccgggacccaggcctagtggatgaggctgactattacngtcaggcgtgggacagcagcactcctatcgtcttcggcacgtcgggaaccaggtccaccggtctacggtcacgacccg

SEQ ID NO: 330643 - DNA, 481 bp, Homo sapiens
  misc_feature: GZ8MTXP02IVS22.4.75.G09.1.454.CMB.2.raw
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgtggtatcagcagaagccaggccagtcccctgtgctggtcatctattatgataccaagcggccctcagggactccctgagcgattctctggctccaactctgggaacacagccactctgaccatcagccgggaccaggctangatgaggctgactatacngtcaggcgtgggacagcagcactccctatcgtcttcggcacgtgggaacctaggtccaccgtcctaggtccacgaccccg

SEQ ID NO: 330644 - DNA, 519 bp, Homo sapiens
  misc_feature: GZ8MTXP02IT2O4.4.75.G09.1.454.CMB.2.raw
  modified_base (342)..(342): a, c, t, g, unknown or other
  misc_feature (342)..(342): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcactcatttattgggatgatgataagcgctacagcccatctctgatgaacaggctcaccntcaccaaggacgcctaccaaaaccagtggtccttacaatgaccaacatggaccctgtgacacagccacatattactgtgcacagagatacggggcagcacggttgggtttgggggcgttacgtgggggccacggggaaccctgggtccaccggtctaccgtcacgcctccgaacccg

SEQ ID NO: 330645 - DNA, 503 bp, Homo sapiens
  misc_feature: GZ8MTXP02JS24J.4.75.G09.1.454.CMB.2.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (487)..(487): a, c, t, g, unknown or other
  misc_feature (487)..(487): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggcctggagtggcttgcactcattattggatgatgataagcgctacagcccatctctgatgaacaggctcacntcacaaggacgcctacaaaacnggtgtcttaacaatnacaanatcggacctgngacacagcacatatactgtgcacagaganaacgggnagcgtacggtggttgggcgtacggtcggggaccgacgggtaccgtggtaaccgaccgtccncctcacgccaccaccg

SEQ ID NO: 330646 - DNA, 549 bp, Homo sapiens
  misc_feature: GZ8MTXP02IC406.4.75.G09.1.454.CMB.2.raw
  modified_base (379)..(379): a, c, t, g, unknown or other
  misc_feature (379)..(379): n is a, c, g, or t
  modified_base (443)..(443): a, c, t, g, unknown or other
  misc_feature (443)..(443): n is a, c, g, or t
tcagagcactgtagcacgaccggtgctcgatttagtatagacatcagggtcttcgtgactcctgtgcccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacagccatctctgatgaacagctcaccatcaacaagaccgacctacaaaaaccagtacgtaccttaanaaatacgaaccaaacagttacggaaccccttgacggacaacaacgccaacaattataactgganacagagagagacggacagacgtacggttgggttgggacgtacggcgggaccgaacggtaacccgtcggtaaccgaccgtcctcctacgaccgaccctaccgaaccg

SEQ ID NO: 330647 - DNA, 507 bp, Homo sapiens
  misc_feature: GZ8MTXP02JSU1U.4.75.G09.1.454.CMB.2.raw
  modified_base (340)..(340): a, c, t, g, unknown or other
  misc_feature (340)..(340): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcacntcaccaagacgcctaccaaaaccaggtgtcccttacaatgaccaacatcggaccctgtgacacagccacatattactgtagcacagagatacgggcagcacgtggttggggcgtacgtcggggccacggggaaccctggtcgaccgtctcctcacgccctcaacccg

SEQ ID NO: 330648 - DNA, 512 bp, Homo sapiens
  misc_feature: GZ8MTXP02JPQZZ.4.75.G09.1.454.CMB.2.raw
  modified_base (339)..(339): a, c, t, g, unknown or other
  misc_feature (339)..(339): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaggccctggagtggcttgcactcatttatgggatgatgataagcgctacagcccatctctgatgaacaggctcaccntcaccaaggacgacctaccaaaaccaggtcgtccttaacaatcgaccaaacatcggaccctgtacggacacagccacatattactgtgcacagacgatacgggcagcacggtggttaggggctacgtcggggccacgggaccctggtcaccgtctcctcacgccctcaacccg

SEQ ID NO: 330649 - DNA, 479 bp, Homo sapiens
  misc_feature: GZ8MTXP02JN1CY.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcggccaccctcagtgtccgtgtccccaggacagacagccagcatcagctgctctggagataaattggggataagtatgttgttggtatcagcagaagccaggccagtcccctgtgctggtcatctattatgataccaagcggccctcagggactccccctgagcgattctctgctccaaactctggggaacacagcccactctgaccatcaagcggacccaggctatgatgagctgactattactgtcaggcgtgggacagcagcactcctatcgtcttcgcacgtgggaaccaaggtcaccgtcagtcacgccaaccgg

SEQ ID NO: 330650 - DNA, 652 bp, Homo sapiens
  misc_feature: GZ8MTXP02J1XRW.4.75.G09.1.454.CMB.2.raw
  modified_base (338)..(338): a, c, t, g, unknown or other
  misc_feature (338)..(338): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgatagcgctacagcccatctctgatgaacaggctcaccntaccaccaaacggaccgaccctaacccaaaaaaccgacgggtacggttacccttaaacaaactacgaacccaacacgtcgggaaccccttggtacgggaccaaccgacgaccaacaacttatttaacctggttagacaacgaaggacggtaacgtaaccgggggaccaagggaccgtaaccggggtttggggttttcgggggacccgtttaaacgggtcggggggacccgaaccgggggtaaaccccgttcgggggtaaccctaacccggttacctacccgttccgaccggtccccttaccccgaaaccccggg

SEQ ID NO: 330651 - DNA, 612 bp, Homo sapiens
  misc_feature: GZ8MTXP02GYCEN.4.75.G09.1.454.CMB.2.raw
  modified_base (346)..(346): a, c, t, g, unknown or other
  misc_feature (346)..(346): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctgggagtggcttgcactctatttagttgggatgatgataagcgctacagccatctctgatagaacaggctcaccntaccaaccaacggaccgaccctaacccgaaaaaccacgggtacgtaccttaacaagtcgaacccaacacgttcggaccctgtacgggaccaacgagacccaactattacgttaacgtgtacgaccaacgagaacgacgtaacggggacaaggccgtaacgggttggggttcggggaccgtaacgggtcgggggccccgaacgggggaccccgttgggaacccgtacccggtcctcccgtaccgaccgtcccctaccgaaaccccgg

SEQ ID NO: 330652 - DNA, 476 bp, Homo sapiens
  misc_feature: GZ8MTXP02H3SBM.4.75.G09.1.454.CMB.2.raw
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcagctgctctgganataaagtggggataagtatgttgtggtatcagcagagcaggccagtcccctgtgctggtcatctattatgatacagcgcctnaggactcccgtgacgcgtattctctggcctcaacctcgtgggaacacacgccactctgaccatcgaggccggaccnggctagtgatgaggctgactatacngtcaggcgtggacagcagcactccctatcgtcttcggctacgtcggaacgacggtcaccggtcacggtcacgacccg

SEQ ID NO: 330653 - DNA, 508 bp, Homo sapiens
  misc_feature: GZ8MTXP02GMRU8.4.75.G09.1.454.CMB.2.raw
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatggatgatgataagcgctacagcccatctctgatgaacaggctcaccntcaccaaggaccgcctaccaaaaccnggtacgtaccttaacaatcgaccaacatcggaccctgtcgacacagccacatatactgtgcacagagatacgggcagcacgtgggtttggggctacgtcggggccacgggaccctggtcaccgtctcctcacgccctacaccg

SEQ ID NO: 330654 - DNA, 501 bp, Homo sapiens
  misc_feature: GZ8MTXP02FTRS3.4.75.G09.1.454.CMB.2.raw
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctgatgaacaggctcacntcacagacgcctacaaaacngtgcttacatgacaanangaccctgtgacacagccacactattactgtgacacgaagagatacggggcagcacggtggttggggctacgtcggggaccacggggaccctggtccgacggtctacctcacgccctacaacccg

SEQ ID NO: 330655 - DNA, 603 bp, Homo sapiens
  misc_feature: GZ8MTXP02IIC9X.4.75.G09.1.454.CMB.2.raw
  modified_base (203)..(203): a, c, t, g, unknown or other
  misc_feature (203)..(203): n is a, c, g, or t
  modified_base (342)..(342): a, c, t, g, unknown or other
  misc_feature (342)..(342): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcactttcnctgggttctcactcagcactagcggagtgggtgtgggctggatccgtcagcccccaggaaaggccctggagtggcttgcactctatttattgggatgatgataagcgctacagcccatctctgatgaacaggctcaccntcaaccaaggaccgaccctaacaaaaccacgggtacgtacctaacaaatcgaaccaacagtcgggacccttggacggaacacgaacgcccaactaacttacttacctgtagacccagaagagaacgtacggggcaggtccgtaacgggtttggggtttacgggggctttaaacgggcgggggacccgaaacgggggtaaccccttcggggtaacctaaccccggtcttcccgtacgaccggtccctacccgaaaccccggg

SEQ ID NO: 330656 - DNA, 540 bp, Homo sapiens
  misc_feature: GZ8MTXP02JQCHE.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggatagtatgttgtgtatcagcagagccaggccagtcccctgtgctggtcatctattatgataccaagccgcctcgagggactccccgtgacgcgtacttctcgtcggtcctcccaaactcgtacggggaaacacacgacccactctcgaccatccacggccgggacccagggcctagtggatggaggctgacttacttacgtgtcagggcgtgggacaggcaaggcctaacgtccctagtcgttcgttcggacgtaccgtacgggaaccgtaacggtccacccggttaccgtacgggtaccacggaacccccg

SEQ ID NO: 330657 - DNA, 576 bp, Homo sapiens
  misc_feature: GZ8MTXP02JV6AV.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaacggccctggagtggcttgcactcatttattgggatgatgataagcgctacagcccatctctgatgacaggctcacatccaaccgaaggaccgaccctaacccgaaaaaacccgacgggttacggttaccctttaacaaacgttacgaaaccctaaacacgtacggacccctaggtacgggacacgacgaccacaacttattactgtcgacacgagagacgtacgggcagctacggtgggtttggggctacggtcggggccgacggggaaccctggtccgaccgtcctccgtcacggccctacccgaacccgg

SEQ ID NO: 330658 - DNA, 476 bp, Homo sapiens
  misc_feature: GZ8MTXP02HGNK1.4.75.G09.1.454.CMB.2.raw
  modified_base (401)..(401): a, c, t, g, unknown or other
  misc_feature (401)..(401): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaatggggataagtatgtttgtggtatcagcagaagccaggccagtcccctgtgctggtcatctattatgataccaagcggccctcagggactccctgagcgattctctggctccaactctgggaacacagccatctgaccatcagccgggaccaggctatggatgaggctgactagttacngtcaggcgtgggacagcagcactccctatgtcttcggcacgtgggaaccaaggtcacgtccaggtcacggacccg

SEQ ID NO: 330659 - DNA, 548 bp, Homo sapiens
  misc_feature: GZ8MTXP02ISPYG.4.75.G09.1.454.CMB.2.raw
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggcctggagtggcttgcactcatttattgggatgatgataagcgctacagcccatctctgatgaacaggctcaccntcaccaacggaccgaccctaccaaaaccgnggtacggtccttaacaatacgacccaaacatcggacccttgtcggacacagacccanattattactgtacgacacgagagaagtacgggacagcgtacggttgggtttggggactacggtcggggaccgacggggaaccctggtaaccaccggtctccgtcacgccctacgaacccgg

SEQ ID NO: 330660 - DNA, 511 bp, Homo sapiens
  misc_feature: GZ8MTXP02GSBLZ.4.75.G09.1.454.CMB.2.raw
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagccatctctgatgacaggctcaccntcaccaaggaccgcctaccaaaaaccnggtacgtccttaacaatacgaccaacatcggaccctgtggacacagccacattattactgtgcacagagatacgggcagcacgtggtttgggctacgtcggggccacgggaccctggtccaccgtctcctcacgcctccgaaccg

SEQ ID NO: 330661 - DNA, 588 bp, Homo sapiens
  misc_feature: GZ8MTXP02IQXKA.4.75.G09.1.454.CMB.2.raw
  modified_base (336)..(336): a, c, t, g, unknown or other
  misc_feature (336)..(336): n is a, c, g, or t
  modified_base (467)..(467): a, c, t, g, unknown or other
  misc_feature (467)..(467): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaaacggccctggagtggcttgcactctatttagtgggatgatgataagcgctacacgccatctctgatgaacnggctaccacactccaaccaacggaccgaccctaaccgaaaaaccgcgggttacgtaccttaacaatacgaaacccaaacactacggaccctggtacggacacgacgaccaactaattatactgtagaccanagagacgtacgggacagcgtacggttgggtttacggggacttacggtacggggaccgaacgggtaacccgtcggtcccgtaacccggtcttacccgacgacgtacccctaccgaaacccgg

SEQ ID NO: 330662 - DNA, 504 bp, Homo sapiens
  misc_feature: GZ8MTXP02HVPTT.4.75.G09.1.454.CMB.2.raw
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgtttgtggtatcagcagaagccaggccagtcccctgtgctggtcatctattatgactaccaagcgcccctgacgggactcccgtgacgcgtatttcctctggtctcccaaacttccgtacggggaacacacgccactctgaccatccgaggccgggaccaggctagnggatgaggctgacttatactgtcaggcgtggganagcagcactcctatcgtacttcggcacgtagggaacctaacggtcaccgtacgtacggcacgacccg

SEQ ID NO: 330663 - DNA, 617 bp, Homo sapiens
  misc_feature: GZ8MTXP02IHQVX.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggtctcactcagcactagcggagtgggtgtgggctggatccgtcacgccccgaggaaacggcctggagtggcttgcactctatttagttgggatgatgaataagcgactacacgcccatctctgatacgaacaggctaccaaccactaccaaccgaaacgggacccgacccctaaacccgaaaaaccgtacgggttacgttaccttaacaaatacgaaaccaaacagtccggaccctgacggaacacaacgaccaactaattaacttacgtgtacgaccaagaagacgaacgtacggacgagcgtaacggttggggtttacgggccttaacgggcggggacccgaacgggggtaccctcggggttaaccacccggttcctacccgtacgaccgtaccctaccgaaccccgg

SEQ ID NO: 330664 - DNA, 519 bp, Homo sapiens
  misc_feature: GZ8MTXP02GGM74.4.75.G09.1.454.CMB.2.raw
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggcctggagtggcttgcactcatttattgggatgatgataagcgctacagcccatctctgatgaacaggctcacntcaccaaggacgcctaccaaaaccnggtcgtccttaacaatcgaaccaacatcggaccctgtacgacacagccacatattacngtgcacagagatacgggnagcacggttggtttggggctacgtcggggaccgacgggaaccctggtccaccggtctcctcacgtcctaccgaacccgg

SEQ ID NO: 330665 - DNA, 538 bp, Homo sapiens
  misc_feature: GZ8MTXP02GVRGF.4.75.G09.1.454.CMB.2.raw
  modified_base (335)..(335): a, c, t, g, unknown or other
  misc_feature (335)..(335): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcagctgctcgtggagataaagtggggataagtatgtttgtggtatcagcagaagccaggccagtcccctgtgctggtcatctattatgactaccgaagccgcctcgagggactcccgtgagcgtattcnctcgcctacaacgtcgtagggaaacacacgcccactctacgacatccgaggccgggaacccaggctaagtggatggaggctagacttattactgtgagggcgtgggacagcacgcacctcctactgttaccttcgggcctacggtacgggaaacccgtaacggtacccgaacccggtccgtaacggtaccaccggaacccccg

SEQ ID NO: 330666 - DNA, 537 bp, Homo sapiens
  misc_feature: GZ8MTXP02HDMLE.4.75.G09.1.454.CMB.2.raw
  modified_base (442)..(442): a, c, t, g, unknown or other
  misc_feature (442)..(442): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttggggataagtatgttgtggtatcagcagaagccaggccacgtcccctgtgctggtcatctattatgataccaagccgcctcgagggactccctgacgcgtattctctggcctaccaacgtctacgggaacacgacgccactctcgacatcgacggccgggaccaggctagtggacgtgaggcttagacttattacgtgtcgagggtcggtagggacncgcagcctacgtccctatcgtaccgttcggacctacggtacgggaacccgtaacggtccgtacccggttaccgtacgggtaccacgaacccccgg

SEQ ID NO: 330667 - DNA, 586 bp, Homo sapiens
  misc_feature: GZ8MTXP02FU3ZX.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaagccctggagtggcttgcactcatttatggatgatgataagcgctacagcccatctctgatgaacaggctcaccatccaaccaaaggaccgaccctaaccaaaaaaccgacgggtcggtacccttaacaaatcgaacccaaacatcggacccctgtcggacacacgcccaacatattacctgtagcacagagaacgtacgggacaagctaacggttgggtttcggggacttaacggtcgggggacccaacgggggaaacccccttggggtaaccctaaccccggttctacccggttaccaacggccccttacccgaaaccccgg

SEQ ID NO: 330668 - DNA, 689 bp, Homo sapiens
  misc_feature: GZ8MTXP02IQNLU.4.75.G09.1.454.CMB.2.raw
  modified_base (314)..(314): a, c, t, g, unknown or other
  misc_feature (314)..(314): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatggatgatgataagcgctacncgccatctctgatgaacaggctcaccataccaaccaaacggaccgacctaacccgaaaaaaccgtagggttacggtaccctttaaacaaacttacgaaacccaaacgacgtacggggacccccttagggtacgggaaccaaccaacggaccccaactaacctttaattaccgttaggttacgcccaaacgaaggaagaacggttaaccgggggactaacgggaccgtaacggggtttagggggttttcgggggaccgttaaaccggggttcgggggaccccgtaacgggggaaaaccccccgtttgggggaacccctaaaccccgggttccttaccccggtaccaacccggttcccctaaccccgaaaccccggg

SEQ ID NO: 330669 - DNA, 501 bp, Homo sapiens
  misc_feature: GZ8MTXP02F9GGM.4.75.G09.1.454.CMB.2.raw
  modified_base (340)..(340): a, c, t, g, unknown or other
  misc_feature (340)..(340): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcatcatttatgggatgatgataagcgctacagcccatctctgatgaacaggctcaccntcaccaaggaccgacctaccaaaaaccaggtgtccttacaatacgaccaaacatcggaccctgtggacacagccacatattactgtgcacagagatacgggcagcacgtggttgggctacgtgggccagggaccctggcacgtctcctcacgcctcaaccg

SEQ ID NO: 330670 - DNA, 570 bp, Homo sapiens
  misc_feature: GZ8MTXP02F2Z7W.4.75.G09.1.454.CMB.2.raw
  modified_base (369)..(369): a, c, t, g, unknown or other
  misc_feature (369)..(369): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggaccgacctaccaaaaaccngggtacggtaccttacaatacgaacccaaacagtcggaccctggtcggacacacgaccacatattactgtgacacagagacgtacgggacagcgtacggtgggtttgggggcctaacggtcgggggacccgaacgggggtaaccccgtgggtaacccgtacccggttctccccgtacgacggtccctacccgaaaccccgg

SEQ ID NO: 330671 - DNA, 533 bp, Homo sapiens
  misc_feature: GZ8MTXP02H6INC.4.75.G09.1.454.CMB.2.raw
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagagcactgtagcacgaccggtgctcgatttagtatagacatcaggttcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccntcacaacggacgcctaccaaaaccnggtcgtcctacaatgaaccaacatcggaccctgtacggacacagaccacattattactgtgacacgagagatacgggcagctacggtgggtttggggctaacgcgggggtaccacggggaaccctggtccgaccggtcctcccgtacacggccctacccgaacccgg

SEQ ID NO: 330672 - DNA, 481 bp, Homo sapiens
  misc_feature: GZ8MTXP02H0Y97.4.75.G09.1.454.CMB.2.raw
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttggggataagtatgtttgtggtatcagcagaagccaggccagtccccngtgctggtcatctattangatacaagccgccctgacgggtactcccgtagagcgtattctctggcctcctaactcgtagggaacacacgccatcngaccatcagccggaccaggactagngatgagctgactattacngtgaggcgtaggacagcagctactcctatgtcttcgcacgtggaaccagtcaccgtctaggccacgacccg

SEQ ID NO: 330673 - DNA, 523 bp, Homo sapiens
  misc_feature: GZ8MTXP02FOLRO.4.75.G09.1.454.CMB.2.raw
  modified_base (291)..(291): a, c, t, g, unknown or other
  misc_feature (291)..(291): n is a, c, g, or t
  modified_base (339)..(340): a, c, t, g, unknown or other
  misc_feature (339)..(340): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttnttgggatgatgataagcgctacagcccatctctgatgaacagctcacnncacagacncctacaaaacngtgtctanatgacanangacctgngancganccanatattactgtagcacgagagtagacggggcagctaacggtggggtttggggacttacggcggggacccgacggggaacccgtcgggtaacgacccggttcctccgtccgacggcctacccgaaccccgg

SEQ ID NO: 330674 - DNA, 597 bp, Homo sapiens
  misc_feature: GZ8MTXP02G1SMM.4.75.G09.1.454.CMB.2.raw
  modified_base (217)..(217): a, c, t, g, unknown or other
  misc_feature (217)..(217): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataaagttggggataagtatgttgtggtatcagcagagccagccagtcccctgngctggtcatctattangactaccaagccggcctcgagggacctcccgtagacgtcgtatttcctctcgggtcctaccgaacctcgtaggggaaaccacgacgcccactcgtcgaacccagtccgaacggcccggggaaccccaggggtcctagtgggaaatggaacggctaggaccttagttaccgtcgtcgaaggtcggtaggggacaggcgaacgtccgtacctcccttagtcggttccgttcgaccgtaacggttaccggggaacctaaacggggttccccaaacccggttccgttaaccgggtacgacccggaaacccccgg

SEQ ID NO: 330675 - DNA, 615 bp, Homo sapiens
  misc_feature: GZ8MTXP02H4J22.4.75.G09.1.454.CMB.2.raw
  modified_base (323)..(323): a, c, t, g, unknown or other
  misc_feature (323)..(323): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggccctggagtggcttgcactcatttatgggatgatgataagcgctacagcccatctntcgatgaacaggctcaccatccaacaacggaccgacctaccgaaaaaccaggtacgtacctacaactcgaacccaacatacggaccctggtacggacaacagacccaacaattaacttacgtagtacgacaaaccgagaagacgtaaccggggacaaggaccgtaacgggttagggtttcgggggaccttaacgggtcgggggacccgaacgggggtaaccccgttcgggtaacccgtaacccggttccgtacccgttaccgacccggtacccttaccccgaaacccccggg

SEQ ID NO: 330676 - DNA, 734 bp, Homo sapiens
  misc_feature: GZ8MTXP02FF0LZ.4.75.G09.1.454.CMB.2.raw
  modified_base (217)..(217): a, c, t, g, unknown or other
  misc_feature (217)..(217): n is a, c, g, or t
  modified_base (288)..(288): a, c, t, g, unknown or other
  misc_feature (288)..(288): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataaagtggggataagtatgttgtggtatcagcagaagccaggccagtcccctgtgctggtcatctattangataccgaagccgcctcgagggacctccccgtgagcgtacttcctcgttggcctaccctaaacgtcgtaggggaaaccaccgacggaccctaacttccgtacgaacccagttcccgaacggccccgggggaaccccaaacggggtcccttaaaggtaggggtaaacgttcgggaaacggggtcttaacgggtaacctttaacgtttaaaccgttcgggttaccggaaacgggggtccggggttacgggggaaaccgtaaacggggccctaaaacgggacccctaccctttaccccccgttaaagtttccgggtttacccggtttcccgggggtaaccaaccccggggtttaacgggggaaaccccgttaaaacgggggttcccctaaacccccggggtttcccgtttaaaccgggggtaccccaaccgggtaaaaccccccccggg

SEQ ID NO: 330677 - DNA, 647 bp, Homo sapiens
  misc_feature: GZ8MTXP02G4IF9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacacgcccatctctgatgaacaggctacaccactccaaccaaacgggaccgaccctacccaaaaaaccgacgggtacgtaccctttaacaaatcggaaacccaaacacgttcgggaacccccttggtacgggaaccaccgaacgcccaaactattaattacctggtacgaccaacaaggaacgagttaccgggggacaacggccgtaacgggttcgggggttttgggggccgttaaacgggttcggggggaccccgaaacgggggtaccccttagggggtaaccctaacccgggttccttacccgtccgaccggtcccctacccgaaacccccggg

SEQ ID NO: 330678 - DNA, 625 bp, Homo sapiens
  misc_feature: GZ8MTXP02GET2Y.4.75.G09.1.454.CMB.2.raw
  modified_base (352)..(352): a, c, t, g, unknown or other
  misc_feature (352)..(352): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaaacggccctggagtggcttgcactctatttagttgggatgatgataagcgactacacgcccatctctgatacgaacacggctacaccntaccaacaaacgggaccaccctaaaccgaaaaaccgtacgggttacgtacccttaacaaactacgaaacccaaacgtaactccgggaaccccttggacggaaaccaacgaacgacccaaactacttaattaccgtgtacgaccagaacgaagtacgaccggggacaacggtacgtacggggttgggtttacggggctaaccggggtcggggacccgaacgggaacccgttggtaaccgtacccgtctcccgtcaccgtcccaccgaaacccgg

SEQ ID NO: 330679 - DNA, 597 bp, Homo sapiens
  misc_feature: GZ8MTXP02JVFZA.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatgggatgatgataagcgctacagcccatctctgatgaacaggctcacataccaaccaaacggaccgacctaacccaaaaaccgacgggttacggttaccctttaaacaaatcggaaacccaaacgtactaccgggaacccctggtacgggaccaacgaacgacccaaactacttaattacgtcgtagaccaacgaggaagacgtacgggacagcgtacgggttgggtttggggctacggtcggggaccgacggggtaaccctgggtccgaccgttcctcgtaccgacgtccctaccgaacccgg

SEQ ID NO: 330680 - DNA, 584 bp, Homo sapiens
  misc_feature: GZ8MTXP02JICKC.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgttgtggtatcagcagaagccaggccagtcccctgtgctggtcatctattatgataccagccgccctagagggacctcccgtgacgcgtattcctctcggcctccaactcgtaggggaacacacgcccactcctcgaaccatccgacggcccggggaacccagggacctagtcgggaagtggagggctaggtacttagttaccgtggtacgaggggtcggtacgggacaggacaggcctaccgttccccgtagttcggttccgtttccgggacctaccggttacggggaaacccgtaaacgggtcccgtaacccggttccgtacgggttacccgaacgtaacccccgg

SEQ ID NO: 330681 - DNA, 531 bp, Homo sapiens
  misc_feature: GZ8MTXP02IV4WH.4.75.G09.1.454.CMB.2.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (440)..(440): a, c, t, g, unknown or other
  misc_feature (440)..(440): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacagcccatctctgatgacagctcacntcacaaggacncctacaaaacnggtcgtaccttacaatcgaccaanatcggacctgtagacacacgaccacattatactgtacgcacgagagagtacgggnagctacggtggtttggggctacggtcggggccgaacggggaacccgtggtaaccgaccgtacctccgtcgacgtccccgtaccgaacccgg

SEQ ID NO: 330682 - DNA, 544 bp, Homo sapiens
  misc_feature: GZ8MTXP02JWIIK.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgccggtgaaacccacacagaccctcacgctgacctgcatcttctctgggttctcactcagcactagcggagtgggtgtggggctggatccgtcagcccccaggaaaggccctggagtggcttgcactcatttattgggatgatgataagcgctacagcccatctctgatgacaggctcaccatccaaccaacggaccgcctaccaaaaaccagggtacgtaccctttaacaactcgaacccaaacatacggaccccgtgtcggacacagccacatatactgtgcacagacgatacgggcagcgtacggtgggtttggggctacggtcggggccgacggggtaaccctggtccgaccggtcctcctcacggccctaccgaacccgg

SEQ ID NO: 330683 - DNA, 515 bp, Homo sapiens
  misc_feature: GZ8MTXP02IVS0M.4.75.G09.1.454.CMB.2.raw
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagagcactgtagcacgaccggtgctcgatttagtatagacatcagggtcttcgtgactcctgtgcccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcactcattattgggatgatgataagcgctacagcccatctctgatgaacaggctcacntcaccaaggacgcctacaaaaaccnggtcggtccttacaatgaccaaacatcggaaccctgtggacacagccacatattacngtgcacagagatacggggacagcacggtggtttcgggggctacgtggggaccagggaaccctgggtcacccggtctcctcacgccctcaacccg

SEQ ID NO: 330684 - DNA, 633 bp, Homo sapiens
  misc_feature: GZ8MTXP02G8ZKW.4.75.G09.1.454.CMB.2.raw
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgctactctatttagttgggatgatganagcgactacagcccatctctgatgaacagctacacatccaaccgaacggaccgaccctaaccgaaaaaccgngggtacgtaccttaaacaaactacggaaacccaaactagtaccggacccgtaggtacggaacacgacgaccaactaattacttaactggtacaccaagaacggaagacgtaacgggacaggaccgtacggttggggtttcggggacgtttaccgggacgggggacccgtaacgggggtaacccttcgggggtaaccctacccggtacccttcccgtaccgtaccgtaccccgtaaccccgaaacccccgggg

SEQ ID NO: 330685 - DNA, 651 bp, Homo sapiens
  misc_feature: GZ8MTXP02GPL9B.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgccccccaggaaacggccctggagtggcttgcactcatttattggatgatgataagcgctacagcccatctctgatgaacaggctacaccatccaaccaaaggaccgaccctaaccaaaaaaccgtaggtacggtaccctttaacaaactacgaacccaaacacgtcggaacccctggtacggaaccacaacgaccccaaacaattaattaacctaggtagaaccacgaaggaacgaacgtaccggggacaacggctaaccggggttggggttttacgggggaccgttaaacggttcgggggacccgaaacgggggtaacccccgttagggggtaaccctaaccccggtacctttacccgtccgtaaaccggcccccttacccgaaaacccccgggg

SEQ ID NO: 330686 - DNA, 594 bp, Homo sapiens
  misc_feature: GZ8MTXP02JVGIS.4.75.G09.1.454.CMB.2.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttntgggatgatgataagcgctacagcccatctctgatgacagctcacntcaccaaggaccgcctaccaaaacgcggtcgtaccttaacaatacgaaccaaacagtacggacccttgtcggacacgtagccaacatatactgtgactacgagagactacggggcaaggcctaacgggttggggtttcgggggaccttaaaccggggttcgggggacccgaaacgggggtaacccccgttggggtaacccgtaaccccgggttcccttaccccgtccgaaccggttcccctacccgaaaacccccgg

SEQ ID NO: 330687 - DNA, 501 bp, Homo sapiens
  misc_feature: GZ8MTXP02HBJGF.4.75.G09.1.454.CMB.2.raw
  modified_base (425)..(425): a, c, t, g, unknown or other
  misc_feature (425)..(425): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgttgtggtatcagcagaagccaggccagtcccctgtgctggtcatctatatgataccaagcgccctcgagggactccctgagcgattctctggcctccaactcgtagggaacacagcccactctagaccatcacggcgggacccaggcagtggatggaggctagactattacgtgtcgaggcgtggacngcacgcactccctagtcgtcttcggactacgtacgggaaccgtaaacggtccaccgtcacggtacacggaaccccg

SEQ ID NO: 330688 - DNA, 719 bp, Homo sapiens
  misc_feature: GZ8MTXP02HBH2B.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccgaaggaaacggcccgtgggagtggcttgcactctatttagttgggatgatgaataagcgactacagccctatctctgatagaacaggctaccaccataccaaaccgaacggacccgaccctaacccgaaaaaccgtacgggttacgtacccttaaacaacgtacgaaacccaaacgtaacgtccgggaccccttaggtaccgggaaccaaccgaaacggaccccctaagtaactttaagttaaccgtcggttacggaaccaaccgaagggaaacggtaacggtaacccgggggacaacgggtacccgtaagggggtttcgggggttttacggggggacccttaacgggggttacggggggaccccgtaaaccgggggtaacccccgttcggggtaaccccgtaacccgggttccccttacccgccgtaacccggtcccccgtaacccgaaacccccggg

SEQ ID NO: 330689 - DNA, 510 bp, Homo sapiens
  misc_feature: GZ8MTXP02H4L8L.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccntcaccaaaggaccgccctaccaaaaaccaggtagtccttacaatgaccaaacatggaccctgtggacacagccacatattactgtgcacagagatacgggcagcacgtgggtttggggctacgtggggccagggaaccctggtcacgtctcctcgacgccctcaacccg

SEQ ID NO: 330690 - DNA, 688 bp, Homo sapiens
  misc_feature: GZ8MTXP02GCCEZ.4.75.G09.1.454.CMB.2.raw
  modified_base (560)..(560): a, c, t, g, unknown or other
  misc_feature (560)..(560): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctaggtacgaaacccacacacgaccctcacgctcgacctgcctaccttctcgtggttcctcactcacgcacgtaggcgggtaggtgggtggtcggctcggactccgtcgaccgaccccgaaggaacgccgtggagtggctgctactactagtttagtaggtatagtatagtaacgtacgccgtactaccgacgtccctattccgttacgtacgtacgtacgaaccgaccggtaccaacccgaacctacccgaaccgaaaccgaaacggacccgtaaacccgtaaaacccgtaaacgggtacggttacccgttaaacctaaacaacgtaccgaaacctaacgtacggtaccgaccgttggaaccgactaacgaccgtactaaacttattacgttagcgganaacccgagtagacgtaggaccggagaccgtaggttcgggttacgggtcggtacgtaccggggaggacccggtaacgccgtcggaaccctaccggtcctaccgaccacccggtaccgaccggaacccgg

SEQ ID NO: 330691 - DNA, 584 bp, Homo sapiens
  misc_feature: GZ8MTXP02JHM3Y.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatgggatgatgataagcgctacagcccatctctgatgaacaggctacaccatacaaccgaacggaccgaccctaacccaaaaccgacggtacggtaccttaacaatacgaccaacatcggaccctaggtacggaccacacgaccactactacttactgtgacacgagagatacgggcagcgtacggttcgggttaggggccttacgggtcggggacccgtaacggggaacccccgtgggtaacccgtacccggttcctacccgtccgaaccggtccctacccgaaaccccgg

SEQ ID NO: 330692 - DNA, 657 bp, Homo sapiens
  misc_feature: GZ8MTXP02G6WYU.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctgggagtggcttgcactcatttattgggatgatgataagcgctacagcctatctctgatagacaggctcacatccaaccaaacggaccgacctaaccaaaaacccgagggtacgtacccttaaacaaactacggaaacccaaacctagtacgggtaaccccctaggtacgggaaccaaccgaacgcccaaacaacttaacttaaccgtgtacgacaaccgaagacgaagtaaccgggggacacggacgtaacggttgggggtttacggggccgttaaccgggtacgggggaccccgaaacgggggtaaacccccgttacgggggtcccaaccccgggttccctaccccgttaccgaccgtacccccgtaccccgaaacccccgggg

SEQ ID NO: 330693 - DNA, 515 bp, Homo sapiens
  misc_feature: GZ8MTXP02IV5YN.4.75.G09.1.454.CMB.2.raw
  modified_base (339)..(339): a, c, t, g, unknown or other
  misc_feature (339)..(339): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcattattgggatgatgataagcgctacagcccatctctgatgaacaggctcaccntcaccaaggaccgcctaccaaaaaccaggtagtaccttacgaatgaccaacatcggaccctgtcggacacacgccacatattactgtgcacgagacgaatacgggcagcacgtggtttaggggctacgtggggccacggggaaccctggtcgaccgtctcctcacgcctccaaccg

SEQ ID NO: 330694 - DNA, 515 bp, Homo sapiens
  misc_feature: GZ8MTXP02JUGTO.4.75.G09.1.454.CMB.2.raw
  modified_base (341)..(341): a, c, t, g, unknown or other
  misc_feature (341)..(341): n is a, c, g, or t
  modified_base (506)..(506): a, c, t, g, unknown or other
  misc_feature (506)..(506): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccntcaccaaggacgacctaccaaaaccaggtagtacccttaacaatagaccaacactcggaccctgtgacacagccacatattactgtgcacagagatacggcagcacggtggttgggctacgtgggccgagggaacccgtggtccgaccggtctcctcgacgtccnccaacccgg

SEQ ID NO: 330695 - DNA, 513 bp, Homo sapiens
  misc_feature: GZ8MTXP02GAWWY.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataagttggggataagtatgttgtggtatcagcagaagccaggccagtcccctgtgctggtcatctattatgactaccgaagccggcctacgacggggacctccccgtgacgtcgtattctcgtcggacctccaaactcgtacgggaacacacgcccactctacgaccatcgacgccgggaccaggtctagtggatggagtctagactattacgtgtcgaggcgtggacagcagtcactcctatcgtcttcgcacgtcggaacgtacggcctaccgtcgtacggccacgaaccccg

SEQ ID NO: 330696 - DNA, 521 bp, Homo sapiens
  misc_feature: GZ8MTXP02IV1CT.4.75.G09.1.454.CMB.2.raw
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcacntcaccaagaccgcctacaaaaccnggtacgtaccttaanaatcgaaccaacatcggaccctgtagacacagccanatatactgtagcacagagatacgggcagcacggtgggttggggctacggtcggggccgacgggaacccgtggtccaccggtctcccgtacacgcctaccgaacccg

SEQ ID NO: 330697 - DNA, 549 bp, Homo sapiens
  misc_feature: GZ8MTXP02JD5L7.4.75.G09.1.454.CMB.2.raw
  modified_base (341)..(341): a, c, t, g, unknown or other
  misc_feature (341)..(341): n is a, c, g, or t
  modified_base (537)..(537): a, c, t, g, unknown or other
  misc_feature (537)..(537): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccntcaccaaaggaccgaccctaccaaaaaaccagggtacggtaccctttaaacaaacttcggaaacccaaacattcgggaaaccccttggtacgggaaccacaaggccccaacattattactgtagacacgagagatacggggcagcaacgtggtttaggggctacgtggggccaggggaaccctggccacgtctccncgacgccacacg

SEQ ID NO: 330698 - DNA, 592 bp, Homo sapiens
  misc_feature: GZ8MTXP02FS4F0.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgttgtgtatcagcagagccaggccagtcccctgtgctggtcatctattatgataccgaagccgcctacgagggacctccccgtgacgtcgttacttcctcgtcgacctacctaacgtcggtaacggaactacgaccgacctacttacgaccgaactacgacgaccggggaccccggaaccgacggtacgtaggtacggtaggtgggtacgtacgtacgtaactttacgttacgtacggtacggacgggtacgggtacggacgacgacgacgtacctacccgtacgttacgtcgttccgtcgaccgtacggtacggaaccgtacgaccgtaccgtacgtacgaccgaccgaaccccg

SEQ ID NO: 330699 - DNA, 689 bp, Homo sapiens
  misc_feature: GZ8MTXP02J2SJ3.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcagcactagcggagtgggtgtgggctggactccgtcacgcccccgaggaaacggccctgggagtggcttgctactctatttagtgggatgatagatacgcactacacgccctatctctgatacgaacacggctccaacctacaccaaacccgaaacggacccgtaaccctaaacccgaaaaaaccgtcggggttaaccgttaaccctttaaacgaaacgttaaccggaaacccaaacgtacgtaccggtaaccccgttggaaccggaccaaccgacgaccaactaacttacgttaactcggtacgccgaacgaacggaagaaccggttacggggaccaacgggtcccgttaaggggttgggggtttcgggaccgttaccgggtacgggggacccgaaccggggtaaccccgttcgggtaacccgtaccggtcccttacccgtaccgacccgtaccccgtaccgaaaccccggg

SEQ ID NO: 330700 - DNA, 562 bp, Homo sapiens
  misc_feature: GZ8MTXP02IS51M.4.75.G09.1.454.CMB.2.raw
  modified_base (271)..(271): a, c, t, g, unknown or other
  misc_feature (271)..(271): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataagtggggataagtatgtttgtggtatcagcagagccaggccagtcccctgngctggtcatctattatgataccaagcgccctgagggactcccgtgagcgattcctctgggtcctaccaaaccgttcgtacggggaacacgacgcccactctacgacccatccgaggtacccgggacccaggtacctaagtgggactaggaggtactgtaacttagttaacctggtccgtaagggtcgtaggggacgtaagcgaacggcctacctcctaacgttcgtccgtttcggacgtaccgtagggaacccgaggtaccgtacccgtaccgtaacggtcaacggccccg

SEQ ID NO: 330701 - DNA, 585 bp, Homo sapiens
  misc_feature: GZ8MTXP02I6SPA.4.75.G09.1.454.CMB.2.raw
  modified_base (401)..(401): a, c, t, g, unknown or other
  misc_feature (401)..(401): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgttgtgtatcagcagaagccaggccacgtcccctgtgctggtcatctattatgataccagcgccctgacgggcctccctgacgcgtattctctggcctaccgaactcgtacgggaaacacgacgacccactactcgaccatcgacggcccgggaccaggtctagnggatggacggctagaaccttagttaccgtgtacgtagggcggtacggggacacggtcgaacggtaccctaccgttacccgttagttcggttaccggtttccgggaccgtaaccggtacggggaaaccccgtaaaggggttaccctacccggttacccgtacggtcccgaacggtaaacccccgg

SEQ ID NO: 330702 - DNA, 631 bp, Homo sapiens
  misc_feature: GZ8MTXP02HWSBE.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgccccgaggaaacgccctggagtggcttgcactcatttagtggatgatgataagcgactacacgcctatctctgatacgaacaggctaccgacactaccgaaccgaaacggacccgtaaccctaaccgaaaaaccgtacgggttacgttaccttaaccaaatacggaaacccaaacgtacgtacggaaccccgttggtacggaccaacgacgaccaactacttaattaccgtggtacaccgaacgaggaacgacgtacgggacaggacgtacgggttggggttttacgggggacttacgggtacggggacccggtaaccgggacccgtggtaacccgacccggttcctcccgacgtaccgcccgttaccgaaccccggg

SEQ ID NO: 330703 - DNA, 618 bp, Homo sapiens
  misc_feature: GZ8MTXP02H6ACO.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtggaataagtaaaggttggggataaagtattggtttgtggtatcagcagaacgccacggccacgtcccctgtgctggtcatactattatagtaacgtaccgaaacggtcccggtacccctacggacggggtaccctcccgtagacgtcgtacttccgttcgtcgggacctacccgtaacgttccgtaggggaacaccgacgaccctactcctacgacctactccgacggcccggggacccaggtctagtggattggacggtctacgtacttagtacgtgtacgagggtcggtacgggacagacgacgtcctaccttaccttcgttcggttaccgttcggaccgtaccgtacgggaaccgtacggtacctacccggtaccgtacggtaccacccggaaccccg

SEQ ID NO: 330704 - DNA, 595 bp, Homo sapiens
  misc_feature: GZ8MTXP02GSQ3S.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctacaccatccaaccaaacggaccgaccctaccaaaaacccgacgggttacgtacccttaacaaattacggaaccaaacagtcggaccctggtacggacacacgcccaacgtattacttaccgtgtacgacgaacgaggagaacgtacgggacaggcgtaacggttggggtttggggaccgttacggtcgggggacccaacgggggtaacccctgggtaaccgacccggtctacccgtcgacggtccctacccgaacccgg

SEQ ID NO: 330705 - DNA, 683 bp, Homo sapiens
  misc_feature: GZ8MTXP02IULZV.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctggttctcactcagcactagcggagtgggtgtgggctggactccgtcacgcccccgaggaaacggcccgtggagtggcttgcactctatttagttggatgatgagtaagcgactacacgccagtctctgatagaacacggtactaccaaccactaccaaaccgaaacggacccgaccctaaacccgaaaaaaccgtacgggtaccggttacccttaaacgtaaacgtcgaaacccaaacgtaacgtaccgggtaaccccgtaggtacggaaccaacgaccgaaccccaaataaccttaattaccgttagacgacaacgaagacgtaacggaccgggacacggtaccgtacgggtttcgggggtttacggggccgttaaaccgggtcgggggaccccgtaaccgggggaacccccgttgggaacccgtacccggttacccctccgttacccgaccgtaccccgaccgtaaacccccggg

SEQ ID NO: 330706 - DNA, 526 bp, Homo sapiens
  misc_feature: GZ8MTXP02GAG18.4.75.G09.1.454.CMB.2.raw
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccccaggaaaggccctggagtggcttgcactcatttattgggatgatgataagcgctacagcccatctctgatgaacaggctcacntcaccaaggaccncctaccaaaacnggtcgtaccttacaatcgaccaacatcgtaccctgtgacacagccanatatactggtncacagagatacgggacagcacggttgggtttggggctacggtcggggaccacggggaaccctggccgtacccgtctccctcacggtccctaccgaaacccgg

SEQ ID NO: 330707 - DNA, 526 bp, Homo sapiens
  misc_feature: GZ8MTXP02GZ943.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacacgcccatctctgatgaacaggctcacntcaccaaggaccgcctaccaaaaccaggtcgtaccttacaatcgaaccaacatcggaccctgtcgacacacgccacatattactgtgacacagagatacgggcagcgacggtgggttgggcgtacggtcggggccacggggaaccctgggtccaccgtcctccgtcacgtccctaccgaacccgg

SEQ ID NO: 330708 - DNA, 595 bp, Homo sapiens
  misc_feature: GZ8MTXP02F1MYZ.4.75.G09.1.454.CMB.2.raw
  modified_base (337)..(337): a, c, t, g, unknown or other
  misc_feature (337)..(337): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggcctggagtggcttgcactcatttatgggatgatgataagcgctacagcccatctctgatgaacaggctcacntcaccaaggaccgacctaccaaaaaccagggtacgtaccttaacaaatacgaaccaaacactcggaccctggtaggaaccacaaggacccaactaattatttaactgttacgacacgaagagaacgtacggggacaggacgtacgggttgggtttacgggggcgttacggcgggggacccgtaacgggggtaaccccgttcgggggtaacctacccggtccttccccgacgaccggaccccttacccgaaaccccggg

SEQ ID NO: 330709 - DNA, 696 bp, Homo sapiens
  misc_feature: GZ8MTXP02INHZW.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctggttctcactcagcactagcggaggtgggtggtgggctggactccgtcacgacccccgaggaaacggcccgtggagtggcttgcactctatttagttggatgatgataagcgtactacacgccctatctctagatagacagctacacataccgaaaccgaaacggaccaacccgtaaaccaaaaaccgtcgggttacgttaacccttaaacgaaacgtccggaaacccaaacgtacgtaccggtaaccccgttggaccggaaaccaacgaaccgacccaaacttaatttaacttaaccgtggacacaaacgaggaacgaacggtaaccgggacgaacgaccggttaaccggggtttgggggtttacgggggacctttaaccggggacgggggacccgtaaaaccgggggtccccgttacgggtaaccccgtaaccccggttacctccccgaccgtaccggtaccccctaacccgaaaacccccgggg

SEQ ID NO: 330710 - DNA, 571 bp, Homo sapiens
  misc_feature: GZ8MTXP02HE6H9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcactcatttagtgggatgatgaatagcgctacacgccatctctgatgaacgagctacaccactccaaccaaaggaccgaccctaaccaaaaaccgcgggtacgtaccttaacaatcgaaccaacagtcgacctgtagacacacgccaacattattactgtacgacacaaggagacgtacggcgagcgtaacggtgggtttggggaccgtacggtcggggcccgaacggggtaaccccgtgggtaacccgacggttccctcccgacgaaccgcccctaccaaaccccggg

SEQ ID NO: 330711 - DNA, 548 bp, Homo sapiens
  misc_feature: GZ8MTXP02H5LOS.4.75.G09.1.454.CMB.2.raw
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattggatgatgataagcgctacagcccatctctgatagacaggctcaccntcaaccaaggaccgacctacccaaaaacaggtacgttacctaanaatacgaaccaacagtcggaccctgacggacacacgccacattactactcgtgacacagagagtacggcagcgtacggtgggtttgggctacggtcggggacccgacggggtaaccctcgggtaaccgaccggtcctccgtacgaccgtccctaccaacccgg

SEQ ID NO: 330712 - DNA, 483 bp, Homo sapiens
  misc_feature: GZ8MTXP02F3QZR.4.75.G09.1.454.CMB.2.raw
  modified_base (402)..(402): a, c, t, g, unknown or other
  misc_feature (402)..(402): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagtggggataagtatgtttgtggtatcagcagaagcaggccagtcccctgtgctggtcatctattatgataccaagccgcctcgagggactccctgagcgattctctggctccaactcgtgggaacacacgccactctgaccatcagccgggaccaggctagtgatgaggctgactatacngtcaggcgtggacagcagcactcctatcgtcttcggacacgtagggaaccaaggtccaccgtccgtaggtcacgaaccccg

SEQ ID NO: 330713 - DNA, 650 bp, Homo sapiens
  misc_feature: GZ8MTXP02FXWYR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactctatttagttgggatgatgataagcgctacacgcccatctctgatgaacaggctcaccatccaaccgaaaggaccgaccctaacccgaaaaaccgagggtacggtacccttaacgaaactacgaacccaaacacgtcgggaacccctggtacggacacgaacgcccaacacttattactaggtacgaccaacgagaagaacgtaccggggacaacggcgtaacgggttcggggttttacgggggccgttaaccggggttacgggggacccgtaaaccgggggtaaccccgttcggggtaaccccgtaaccccggtttccttccccgttaccgaaccgggtccccttaccccgaaaaccccggg

SEQ ID NO: 330714 - DNA, 668 bp, Homo sapiens
  misc_feature: GZ8MTXP02JZ22G.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaacggccctggagtggcttgcactcatttagttgggatgatgataagcgctacagcccatctctgatgaacaggctacaccntaccaaccaaacggaccgaccctaacccgaaaaaccgagggtacgttaccctttaaacaacttacgaacccaaacgacgtacgggacccctggtacggaccaacgacgacccaactaacttaactttacgtggtacgaccaaccgaaggaaggaacggttaccgggggaccaagggtcccggtaaccggggtttgggggtttacgggggaccgttaaaccgggttcggggggaccccgaacgggggtaaacccccgttggggtaacccgtacccggttcccgttccccgtaccgacccggtcccctacccggaaacccccggg

SEQ ID NO: 330715 - DNA, 621 bp, Homo sapiens
  misc_feature: GZ8MTXP02JRV1U.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacacgcccatctctgatgaacaggctacaccataccaaccaaacggaccgaccctaaccaaaaaccgacgggtacgtacccttaacaactagaacccaacagtccggaccctaggtcggaaccaacacgaccaactaacttattacctgtacgaccaacgaaggaacgagtacgggacgacgacgtacgggttggggtttacgggggaccgttacgggtacgggggtacccggaaccgggggtaaaccccgttcggggtccgtaacccggttccctaccgtaccgaccgtcccctacccgaaaccccggg

SEQ ID NO: 330716 - DNA, 634 bp, Homo sapiens
  misc_feature: GZ8MTXP02G2CWE.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgcccccgaaggaaacggcccgtggagtggcttgctactctatttagtggatgatgataagcgactacacgccatctctagatacgaacacggctacaccactaccaaccgaacggaccgaccctaaccaaaaaccgtgggtacgtaccttaaacaactacgaaacccaacgtacgtaccggacccttaggacgaaccaacgacgacccaaatacttaattacgtggacgacaacgaaggagaacgtaccgggactacggacccgtagggtttcggggttacggggacgttacgggaccgggggacccgaacggggtaaccccgttggtaacccgtacccgtccctaccgtaccgaaccgtcccccgtaacgaaaccccggg

SEQ ID NO: 330717 - DNA, 617 bp, Homo sapiens
  misc_feature: GZ8MTXP02F7Y2S.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacacgccatctctgatgaacaggctacacccataccaaccaaacggaccgaccctaacccaaaaaacccgaggttacggtaccctttaacaactacgaaccaaacactcgggaccctggtacggaacacacgacccaacaattattactgtacgacaacagagaacgtacgggacagccgtaacgggttgggtttcggggacgttacgggtacgggggacccgaacgggggaaccccgttacgggtcccgtaacccgggttccctaccgttacccgacggtcccccgtacccgaaaacccccggg

SEQ ID NO: 330718 - DNA, 558 bp, Homo sapiens
  misc_feature: GZ8MTXP02IZI6K.4.75.G09.1.454.CMB.2.raw
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcacgtcatttattgggatgatgataagcgctacagcccatctctgatgaacaggctcacatcacaaaggccgacctaccaaaaaccngtacgtaccttaacgaatcgaacaacatcggacctgngacanacgccacatatacgtgtanacacagagatacgggcaagcctaacggtggtttagggctacggttacggggacccgaacggggtaaccccgttgggaaccctaacccggtctccccgtacgaacggccccttacccaaaacccccggg

SEQ ID NO: 330719 - DNA, 529 bp, Homo sapiens
  misc_feature: GZ8MTXP02F06MA.4.75.G09.1.454.CMB.2.raw
  modified_base (340)..(341): a, c, t, g, unknown or other
  misc_feature (340)..(341): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttatgggatgatgataagcgctacacgcccatctctgatgacagctcacnncacagacncctacaaacngtgtctanatnacanancgctgngacacacgcacatattactgtgaccanagagtacgacggcaagcgtacggttcggggtttaggggcttacgggcgggacccggaaacgggacccgttggtaaccgcccggttcctcccggttacaccggccctacccgaaacccggg

SEQ ID NO: 330720 - DNA, 606 bp, Homo sapiens
  misc_feature: GZ8MTXP02IMC8M.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttggcactctatttatggatgatgatagcgctacagcccatctctcgatagaacaggctacacataccaaccgaacgaccgaccctaaccaaaaaccgtaggtacgtacctaacaaactacgaaaccaaacagtacggaaccctgtacggacacgaacgccaactaattattaaccgtgtacgacaacgaagtaagacgtaaccgggacacgaccggtaagggttcggggtttacggggacctacgggtacgggggaccgaccggggtaaacccgtcggtaaccgacccggtcctcccgtacgaccgaccctacccgaaaccccgg

SEQ ID NO: 330721 - DNA, 555 bp, Homo sapiens
  misc_feature: GZ8MTXP02HVHVB.4.75.G09.1.454.CMB.2.raw
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactaggcggagtgggtgtgggctggactccgtcgacgcccccgaggaaacggcccgtggagtggcttgcactctagtttagttggatgatgaataagcnctacacgccatctctgatgaacngctcacntcaacagacacctacaaaacnggtacgtactanaatacgacaacagtcgacctgacgacacacgaccanatatactgcnacgagagagacggcagcgtacggttgggttcgggcttacgggacgggggacccaacggggtaacccgtcgggtcccgtacccggtaccgttaccgccgaaccgtcccccttaacccgaaaccccggg

SEQ ID NO: 330722 - DNA, 624 bp, Homo sapiens
  misc_feature: GZ8MTXP02IQY27.4.75.G09.1.454.CMB.2.raw
  modified_base (349)..(349): a, c, t, g, unknown or other
  misc_feature (349)..(349): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctcttggttctcactcagcactagcggaggtgggtggtgggctggatccgtcacgccccaggaacgccgtggagtggcttgcactctatttagttgggtatgatgataagcgctacacgccatctctgatgaacaggctaccaccntaccaaacccgaacgggaccctaaccccgtaaccaaaaaccgtacgggtaccgttaccttaacaaatacgaaaccaaactagtccgacccgttggacggaccacacgaccctaactaattattaccgtgtaccgaccagaagagaacggtacggcaagtcgtaacggttggggtttacggggaccgtttaacggggccggggaccggtaaaccggggtacccgttacggtaacccgtacccgtcgtaccctacgaccgcccgtaaccgaacccgg

SEQ ID NO: 330723 - DNA, 696 bp, Homo sapiens
  misc_feature: GZ8MTXP02IS2NZ.4.75.G09.1.454.CMB.2.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcagctgctntggatataagtggggataagtatgttgtgtntnagnagagccagccacgtccctgtgctgtcatctattatagaactaccgaaggccgcccctagacgggtaccctccccgtagacggtccgtactttccgttcgtcgggtaccttacccgtaaaccttccggtaccggggaaactaccgacgcccgtacttccgacgaacctacgtacccgaacgggacccccggggaaccccaggggtaccttagggtggtaaccggtagggtacggtaccgttaaggttaaaccctttaagttaacccgtcgggttaccggaacgggggtccggttaaggggaacgtaacggaccgtaacggtaccctaacccgtttacccttaagttcggttcccttaccgggaccgttaaccggtacggggtaaaccccgtaacgggtacccgttaacccggtccgtaaccggtacccgaacccggtaacccccg

SEQ ID NO: 330724 - DNA, 658 bp, Homo sapiens
  misc_feature: GZ8MTXP02HKMUB.4.75.G09.1.454.CMB.2.raw
  modified_base (260)..(260): a, c, t, g, unknown or other
  misc_feature (260)..(260): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccacctcagtcgtccgtcgtccccaggacagacagccagcatcagctgctcgtaggagtaagttaaagttggggaattaagtagtgtttgtggtatnagcagacgccgagccacgtccctgtcgtcgtcggtacattacttattactagtaactaccgaaacggcccggtaccctacggaggggaccccttcccgtaggacgtacgtactttccgtcgtcggtaccttaccgaacgttccgtaacgggaacacgtaccgcctactcctacgaccgtactacgacgggacccgggaacccagggtcctaggacggtagttacggggacgttcgtaacgtaccctttaagttacccgtaggtaccggtaagggtcccgggtaaggggaacctacgacgtaaccggtacctacccggtttaccctagtttcgtacccgttcggaccgtacggtacgaaccgtacggtccctaacggtcgtaccgcgaaccgaccccgg

SEQ ID NO: 330725 - DNA, 761 bp, Homo sapiens
  misc_feature: GZ8MTXP02JJ5RH.4.75.G09.1.454.CMB.2.raw
tcagagcactgtagcacgaccggtgctcgatttagtatagacatcgaggggctgggcctcaggaagcagcatcggaggtgcctcagccatggcatggatccctctcttcctcggcgtccttgcttactgcacaggactccggtggcctcctatgagctgactcacgcccaccctcagtcgtccgtcgtccccaggacagacagccagcatcagctgctcgtaggaagtaagtaaaggttggggaattaaggttagttggtttagttggtatcgagcaagaacgccgaggcctacgtcccctgtcgcgtggtctattcttaattacgtagaacttaaccgaaacggcccggtaccctacggaacggggtaccctaccccgtaggacgtcgtactttccgtcgtcggccttacccgtaacgttccgtaacgggaaaccacgtacgaccctacgtcgtaaccgaacctacgtaccgaacgggaccccggggaaccccgtaaggggtccttaaggtacgggtaacgttacgggaacggtcgttaacggttaactttaacgtttaccgtacgggttaccggaacggggtcgggtaacggggaccaacggtacgaaccgtcccgtaacccgtttacccggttaagtttcccggttacccggttaccgggaccgtaaccggggtacccggggtaaacccgttaaacccggggtccctaaccccgggttaccgtaaccgggttaccccgaaacccggtaaaccccccgg

SEQ ID NO: 330726 - DNA, 573 bp, Homo sapiens
  misc_feature: GZ8MTXP02FN3F3.4.75.G09.1.454.CMB.2.raw
  modified_base (480)..(480): a, c, t, g, unknown or other
  misc_feature (480)..(480): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctcgtggagataaagtggggataagtatgttgtgtatcagcagagccaggccacgtcccctgtgctggtcatctattatgaataccgaagccgccctcgacgggtacctcccgtggacgtcgtactttccgtcgtcggtcctacccgtaaacttccgtacgggaaccacgaccgtccctacgtcctacgaacccagtaccgacggcccggggaacccagggtcctaaggtcggaatggacggtctagtacttagttacgtggtcgtcgggngtagggacagcacgacctacctacctagtcgttcgttcgaccgacgtacgggaaccgaacggttcccaccgttccgtacggaccaccgacccg

SEQ ID NO: 330727 - DNA, 595 bp, Homo sapiens
  misc_feature: GZ8MTXP02GRJN5.4.75.G09.1.454.CMB.2.raw
  modified_base (373)..(373): a, c, t, g, unknown or other
  misc_feature (373)..(373): n is a, c, g, or t
  modified_base (444)..(444): a, c, t, g, unknown or other
  misc_feature (444)..(444): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaacgccctggagtggcttgcatcatttattgggatgatgataagcgctacagcccatctctgatgaacaggctacaccatccaaccaaaggaccgacctaccaaaaaccgnggtacggtaccttaacaatacgaaccaacatcggaaccctgtggacacacgccaacataattacctaggtnacaacagagaacgtacggggcaagccgtaacggttggggtttaggggaccgttaaacgggttcgggggacccgaaacgggggtaaccccctgggggtaaccctaacccggttccttacccccgtaccgaccgtaccccgtacccgaacccg

SEQ ID NO: 330728 - DNA, 626 bp, Homo sapiens
  misc_feature: GZ8MTXP02JYCEC.4.75.G09.1.454.CMB.2.raw
  modified_base (344)..(344): a, c, t, g, unknown or other
  misc_feature (344)..(344): n is a, c, g, or t
  modified_base (486)..(486): a, c, t, g, unknown or other
  misc_feature (486)..(486): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggcccgtggagtggcttgcactctatttattgggatgatgataagcgactacagccatctctgatgaacaggctacacntaccaaccgaaacggaccgacctaacccaaaaaccgacggtacggtacccttaaacaagtacgaaccaacgactacggaccctgtacggacacacgtaccaactattaattacctgtagcaacgaggaagtacgtacggganacggtacgtacgggttcggggtttcggggaccgttaaccggggtcgggggtacccgaacgggggtaaaccccgttcggggtaacccgtaacccggttccgttacccgtaccgacggtccccgttacccgaaaccccgggg

SEQ ID NO: 330729 - DNA, 543 bp, Homo sapiens
  misc_feature: GZ8MTXP02FTP4F.4.75.G09.1.454.CMB.2.raw
  modified_base (463)..(463): a, c, t, g, unknown or other
  misc_feature (463)..(463): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctgatgaacaggctacaccatcaaccaaaggaccgacctaaccaaaaaaccaggttacgtaccttaacaaatacgaaccaaacagtcggaccctggtaggaacacacgaccacaatattactgtagacacagagagtacggnagcacggttggttgggctacggtcggggaccacggggaccctggtccaccggtcctaccgtcacgcctaccgaaacccgg

SEQ ID NO: 330730 - DNA, 640 bp, Homo sapiens
  misc_feature: GZ8MTXP02FVAHK.4.75.G09.1.454.CMB.2.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctcnggagataaagttggggataagtatgttgtggtatnagcagagccaggccagtcccctgtgctggtcatctattatgataccaagcggcctcgaggactccctgagcgtattctctggctccaactcgtacgggaacacacgacccactcctacgaaccctagtccgaacggccggggaaccccaggggaccttagtggggtaaattcgggaacgggtcgtagtaacccttaagttaccgtacgttacgagggccggttagggggaccaagggcgaacggacccgtaccttaccccgttaagttccggttaccgtttccgggtaccgaacccggtttacgggggaaaccccgtaaaacgggggtttccccgtaaaaccccggggtttcccgtttaaccgggggtacccaaccgggggaaacccccccg

SEQ ID NO: 330731 - DNA, 559 bp, Homo sapiens
  misc_feature: GZ8MTXP02IDEL0.4.75.G09.1.454.CMB.2.raw
  modified_base (340)..(341): a, c, t, g, unknown or other
  misc_feature (340)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcactcatttagttggatgatgataagcgctacagcccatctctgatgacaggctcacnncaacaacgaccacctacaaaacctggtacgtaccctaagaactcgaaccaacactacggaccctgtacggacacacgaccaactattatactgtacgacacgagaagagtacggcaagcgtacggtgggtttcggggacttacgggtcggggaccgtaacgggtacccgtggtaacccgaccggtccttcccgccgaccggtccctacccgaacccgg

SEQ ID NO: 330732 - DNA, 670 bp, Homo sapiens
  misc_feature: GZ8MTXP02GXUYG.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttagtggatgatgataagcgctacagccatctctgatgaacagctcaccataccaaccaaggaccgaccctaaccaaaaaccagggtacgtacccttaacaacttacgaacccaaacgagtacgggacccctaggtacggaaccaaccaacggacccctaacaacttaactttaaccgtcggtacgaccaaaccgaaggaacgaaacggttaacccgggggacgaacggtaccgttaaccggggttgggggttttacgggggtacccgttaaacgggttcgggggggaacccctaaacgggggaaacccccgttcgggggttaacccaaccccggttcctttaccccgtaccgaccggaccccttacccctaaaaccccggg

SEQ ID NO: 330733 - DNA, 569 bp, Homo sapiens
  misc_feature: GZ8MTXP02FGITG.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcactcatttattgggatgatgataagcgctacagcccatctctgatgaacaggctcacntcaaccaaggaccgccctaccaaaaaccagggtcgtaccctttaacaatcgaacccaaacactacggaacccctggtcgggaaccacaacgcccaacattattaacctgtcgacaacgagaagactacggggcaagcgaacggttgggtttcggggctacggtcgggggacccacggggaacccctggtccgaccggtcctcccgtacacggccctcccgaaacccgg

SEQ ID NO: 330734 - DNA, 547 bp, Homo sapiens
  misc_feature: GZ8MTXP02HVWUQ.4.75.G09.1.454.CMB.2.raw
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacnggctcacntcacaaggaccgacctaccaaaacaggtcgtaccttacaatacgaccaactatcggaccctgtcggacacagccanatattactgtancacagagagtacgggcagcgtacggtgggtttcgggggcttaacggtcggggaccgacggggtaaccccgtggtaaccgacccggtcctcccgtacaccggtccctacccgaaacccgg

SEQ ID NO: 330735 - DNA, 587 bp, Homo sapiens
  misc_feature: GZ8MTXP02F65FB.4.75.G09.1.454.CMB.2.raw
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (439)..(439): a, c, t, g, unknown or other
  misc_feature (439)..(439): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggcctggagtggcttgcactctatttagtgggatgatgataagcgactacacgcccatctctgatgaacngctacacactccaacgaacggaccacctaaccaaaaccgnggtacgtaccttaacaatacgaaccaagacgtacgacccgtgtacggacaaccgacgacctanaacttaacttacgtacgtagaccaacgaaggagtaacggacgggagacggtaccgtaggggttcgggttacggggacttacggggcgggacccgtacggggaaccctggtccgtaccgtcctccgtcgaccggccctacgaaccccgg

SEQ ID NO: 330736 - DNA, 747 bp, Homo sapiens
  misc_feature: GZ8MTXP02FFZG9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccaggaaaggccctggagtggcttgcactctatttagttgggatgatgataagcgctacacgcccatctctgatagaacacggctaccaaccactaccaaacccgaaacgggaaccgacccctaaacccgaaaaaacccgaggggttaccgggttaccctttaaaccaaacttaacggaaaccccaaaacgaacgttacgggggaaacccccttgggtacggggaaaccaaccgaaaccggaccccaaactaactttaaactttaaccgttggtacgacccaaacgaacggaaaggaacgtaaaccgggggctaaacgggaccggtaaaccggggtttagggggttttcggggggtacccttaaacggggttcggggggaaccccgtaaaacccggggggtaaacccccgttcgggggtaacccctaaaccccggggtttcccgtcccccttaccgtaaccggccccccttaccccgaaaacccccggg

SEQ ID NO: 330737 - DNA, 625 bp, Homo sapiens
  misc_feature: GZ8MTXP02GZXQT.4.75.G09.1.454.CMB.2.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (425)..(425): a, c, t, g, unknown or other
  misc_feature (425)..(425): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtgtccgtcgtccccaggacagacagccagcatcagctgctcnggagataagtggggataagtntgttgtgtatcagcagacgccgaggccacgtcccctgtcgcgtggtcatctattagagtactaccacgccgccctcgacggtcctcccgtgacgcgtattccgtctcggaccttacccacgttacgtacgggaacacacgacccacttccacgaaccagtacgacggacccgggacccaggtacctagngggtaagtcgggaggtccgtagtaaccgtttacgtttacgtcggtaccggagggtacccgggttagggaacccgaggacccgtaaacgtcccgtaaacccgttcccgttaaacgttccgggttaccgtttaccgggaccgtacggtaccgggaaccgtaacggtccgtacccggtccgtacgtaccgacgtaacccccgg

SEQ ID NO: 330738 - DNA, 653 bp, Homo sapiens
  misc_feature: GZ8MTXP02H3FM1.4.75.G09.1.454.CMB.2.raw
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgccccgaggaaacggcccgtggagtggcttgcactctatttagttggatgatgaatagcnctacncgccatctctgatgaacaggctacaccntaccaacaaacggaccacctaacccgaaaacgacggttcggtacctaacaatacgaacccaacgtacgtcggaccctggtacggaccaacacgaccaactaacttaattaccgtagggtcactaaacgaggaacgacgtaacggggaccaggtaccgtaacggggttgggggttttacgggggaccgttaccggggtcgggggtaaccccgtaacgggggtaaaccccgttcggggttcccgaaaccccggttccccgttacccgtacccgtacccggtaccccgttaacccccgaaaccccgggg

SEQ ID NO: 330739 - DNA, 645 bp, Homo sapiens
  misc_feature: GZ8MTXP02HHZX9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggccctacgctggtagaaacccacacagaccctcacgctgacctgcaccttctctggttctcactcagcactagcggagtgggtgtgggctggatccgtcacgaccccgaggaacgccgtggagtgcttgcacgtctagtttagtgggtatgtatagaagtacgcctactacgacgtacctatctcgtagactacgaacgtacgactacaacctacaccgaaaccgaaacggacccgtaaccctaaaacccgaaaacgtcggggtaccttaaccttaaacacgtaaccgaaccaacgtacgtacccgaccgtgacgacacacgtaccatactttaacgtcgtgacaaccgagacgtagaacgtcggacgtaacggtccggttagggttcgggttacgggaccgttacgggggaccgggtaccgaaaccgggtcccgtacgggtaaccctccggttaccctccgtacgtaccccgaccgttaacccgaaccccgg

SEQ ID NO: 330740 - DNA, 496 bp, Homo sapiens
  misc_feature: GZ8MTXP02FKG2K.4.75.G09.1.454.CMB.2.raw
  modified_base (457)..(457): a, c, t, g, unknown or other
  misc_feature (457)..(457): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaatggggataagtatgttgtggtatcagcagaagccaggccagtcccctgtgctggtcatctatatgataccaagcgcctcaggactccctgagcgattcctctggcctccaaactctgggaaacacagcccactctgaccatcacggccgggacccaggctagtggactggaaggctgaacttacgttaactgtcgaggcggtgggacagcagcacgtccctatcgtcgttcgacncgtgggaaccaggtccaccgtctacggtcacgaaccccg

SEQ ID NO: 330741 - DNA, 628 bp, Homo sapiens
  misc_feature: GZ8MTXP02JTFM0.4.75.G09.1.454.CMB.2.raw
  modified_base (317)..(317): a, c, t, g, unknown or other
  misc_feature (317)..(317): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtggggctggatccgtcacgcccccaggaaacgccctggagtggcttgcactctatttagttgggatgatgataagcgctacngcccatctctgatgaacaggctacaccatccaacgaaacgaccgacctaaccaaaaaccgtcgggtacgtaccctttaaacaacttacgaaacccaaacgtacgtaccggaaccccttaggtacgggaaccacgaaacggaccaacctattaacttacgtacgtagaccaacgagaagacggtacggggcacgacgtacggttgggtttacgggggctttaaccgggcgggggacccgaaacgggggtacccctagggtaacccgtaacccgtccgtccgtaccgaccgtacccgtacccaaaccccgggg

SEQ ID NO: 330742 - DNA, 558 bp, Homo sapiens
  misc_feature: GZ8MTXP02H6LWV.4.75.G09.1.454.CMB.2.raw
  modified_base (343)..(343): a, c, t, g, unknown or other
  misc_feature (343)..(343): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (543)..(543): a, c, t, g, unknown or other
  misc_feature (543)..(543): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaagaaaggccctggagtggcttgcactcatttattgggatgatgaataagcgctacagcccatctctgatcgaacaggctcaccntccaaccaaacggaccgacccttaacccgaaaaaaccgtagggtacgttacccttaacaaactacgaacccaaacgtaacgtacggacccctgtacggacacgagaccactacttattaccngtagcanagagatacgggnagcgacggtgggttgggctaggcgtcgggaccgtaggacccgtggtccgaccgtctccnccgacgccctacccg

SEQ ID NO: 330743 - DNA, 666 bp, Homo sapiens
  misc_feature: GZ8MTXP02JG2RR.4.75.G09.1.454.CMB.2.raw
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgggttctcactcagcactagcggagtgggtgtgggctggatccgtcacgccccaggaaacggccctggagtggcttgcactcatttagtggatgatgatagcgctacncgcccatctctgatgacaggctcacntccacgacgacgacctaccaaaacgngtacgtaccttaacgaaatcgaaccaaacacgtacggtacccctaggtacggaaccaaccgaagaccccaaactaactttaacttaccgtcgggtacgacccgaaaccgaaggtaaacggaacgtaaccggggaccgtaacgaccggttaaccggggtttgggggtttacgggggacccgttaacggggtccgggggtaccccgaaacgggggtaaacccccgttcggggtaacccgtaaccccgggtttccctaccccgttaccgacccggtacccccgtaacccgaaaccccccgggg

SEQ ID NO: 330744 - DNA, 662 bp, Homo sapiens
  misc_feature: GZ8MTXP02ICCSI.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccacctcagtgtccgtcgtcccaggacagacacgccagcatcagctgctcgtaggagtaattaaaggtggggaataagtatggtttgtgtatcagacaagaacgccgacggcctacgtccccgtgtcgtcgtcggtacattcgtaattagtagtaactaaccgaacggcccgtaccccgtaggacgggtacccctccggtagacgtcgtatttccgtcgtcggcctaccgtaacgtcgtacggaaccactaacgccctactctacgaaccctagtccgacggacccgggaacccagggtacctaggtaggaagtcggaacggtcttacgaactttaacgtacgttcggacggtacgggacgggtacggaaccgcgaccgaacgtcctacccgttcccgtaacgttccggtccgttccggaccgttaaccggtaccggggtaacccgtaaacgggtccccgtaccggtaccgttaccggaccaaaaccgggtaacccccg

SEQ ID NO: 330745 - DNA, 670 bp, Homo sapiens
  misc_feature: GZ8MTXP02FK2I0.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactctatttagtgggatgatgataagcgctacagccccatctctgatgaacaggcctacaccactaccaaccgaaacggaccgaccctaaacccgaaaaaccgtacgggttacgtaccctttaaacaaactacgaaccaaacacgtaccggaccctagtacgggaaccacgaacgaccccaaatacttaacttacgtacgtagaacccaacgaggagaacggtaccggggacaacggacgtaaccggggtttgggggtttacggggacgttaaccgggttacgggggaccccgtaaaacgggggaacccccgttcggggtaacccgtaacccggttccctaccccgttaccgaacccgtcccccgttaccccgaaaacccccgggg

SEQ ID NO: 330746 - DNA, 792 bp, Homo sapiens
  misc_feature: GZ8MTXP02IK2VI.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcagcactagcggagtgggtgtgggctggatccgtcacgccccgaggaaaggccctggacgtggcttgcactctatttagttgggatgatgataagcgactacgacgacctatctctagactacgaacgacgtactaccaacctacgtaccaaaccgaaaccgggtaccccgtaacccccgtaaaacccgaaaaaacccgtacgggggttaccctttaaccctaaaacgtaacgtaaaccaacccgtaaaacccgtagttaccccgggtaaccgttacggggtaaccggaaacccaaccgtaaaccggaaccctaaccgttaaaacttttacgtttaacccgtttaggtaaaccgacccgaaagttaacgggaaacggtttaaaccgggaccggggaaacccgtaagggtacccgggttaaacggggttttacggggggtttaccgggggaccctttaaacgggggacccgggggtaacccggtaaacccgggggttaacccggttaccggtaacccgttaaccccggttccttacccgtaaccgaccccgttaccccgtaacccgtaaaccccggg

SEQ ID NO: 330747 - DNA, 651 bp, Homo sapiens
  misc_feature: GZ8MTXP02JXVN2.4.75.G09.1.454.CMB.2.raw
  modified_base (320)..(320): a, c, t, g, unknown or other
  misc_feature (320)..(320): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctggttctcactcagcactagcggagtgggtgtgggctggatccgtcacgccccgaggaacggccgtggagtgcttgctactctatttagtggatgatagagtaacgcgactacncgccatctctgatagacagctacacactaccaaaccgaacggaccgaccctaaaccgaaaaccgtacgggttacgttacccttaacgaacgtacgaaacccaacgtacgtcggaaccctaggtacggacaacgacgacccaaactaattaacttaccgtagtacgacgaacgaaggaaggtacgtaccggggacgacggtaccggtaacggggttggggttacggggccgttacggggtccggggacccggaaccgggtaacccggttcggtaacccgtaaccccggttccgtacccgttacgaaccccggtccctacccggaaaccccgg

SEQ ID NO: 330748 - DNA, 517 bp, Homo sapiens
  misc_feature: GZ8MTXP02IXWZ1.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggaccgcctacaaaaccaggtacgtccttacaatgaaccaaacatcggaccctgtacggacacagccacatattactgtgcacagagatacgggcagcacggtggtttggggctacgtggggccgacgggaaccctggtccgaccgtctacctcacgcctaccaacccg

SEQ ID NO: 330749 - DNA, 595 bp, Homo sapiens
  misc_feature: GZ8MTXP02GDDI0.4.75.G09.1.454.CMB.2.raw
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (447)..(447): a, c, t, g, unknown or other
  misc_feature (447)..(447): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggctggatcgtcacgccccaggaagcctggagtggcttgcactctattagtggatgatgataagcgctacngcccatctctagatgaacaggctacacctntccaaccaacgggtaccaccctaaccaaaaaccgtggtacgtacccttaacaatacgaacccaaactacgtacggggacccctaggtacggaacacaacggtacccaanacttaattaccgtggtacaaccacgtagagacgtaccgggacgacgtacgtacgggttgggttacgggacgtacgggacgggaccgtaaccgggtaccgtcggtaaccgtaccgtcctacccgtacgaccgtacccgtaccgtaaccg

SEQ ID NO: 330750 - DNA, 649 bp, Homo sapiens
  misc_feature: GZ8MTXP02JDSVM.4.75.G09.1.454.CMB.2.raw
  modified_base (236)..(236): a, c, t, g, unknown or other
  misc_feature (236)..(236): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtggtgnggctggactccgtcacgccccaggaacgcctggagtggcttgcactctattagttggatgatgataagcgctacacgcccatcgtctacgatagaacacggctaccacctagccaacgaacggaccgacccgtaaccaaaaaccgtgggttaccgtacctttaacaacgttacgaaccccaagaacgttcgggaccccttaggaccggaacaaccgacggtacccaaactatttaacttacctggtacaccacgaagaacgtacgacggggaccaaaggcccgtaacggttagggggtttcggggaccttaaaccggggtcgggggtacccgaaaacggggtaccccgtttggggccccttacccggtttaaccccgtacccgtaccgtacccgtcccgtacccgtaacccgg

SEQ ID NO: 330751 - DNA, 633 bp, Homo sapiens
  misc_feature: GZ8MTXP02H17H3.4.75.G09.1.454.CMB.2.raw
  modified_base (351)..(351): a, c, t, g, unknown or other
  misc_feature (351)..(351): n is a, c, g, or t
  modified_base (505)..(505): a, c, t, g, unknown or other
  misc_feature (505)..(505): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcactctatttagttgggatgatgaataagcgctacacgcccatctctgatacgaacacggctacaaccntaccaaccgaaacggaccgaccctaaccgaaaaaccgtacgggtacgtacccttaacgaaatcgaaacccaaactacgtaccggaaccctggtacggacacgaacgcccaacaattagttacctggtacacaacaagaacggaagtaccggggnaacggtacgtaacgggttggggtttacggggaccttaaacgggcgggggtaccaaacgggggtaacccctggggtaacccacccggttacctcccgttaccgaccggtacccctaccgaaaccccggg

SEQ ID NO: 330752 - DNA, 510 bp, Homo sapiens
  misc_feature: GZ8MTXP02FMSXX.4.75.G09.1.454.CMB.2.raw
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccccaggaaaggccctggagtggcttgcactcatttattgggatgatgataagcgctacagcccatctctgatgaacaggctcaccntcaccaaggacgcctacaaaaccnggtggtccttaacaatgaccaacatggaccctgtggacacagccacatattactagtgcacagagatacgggcagcacggtgggtttgggctacgtcggggccgacgggaccctggtccaccgtctcctcacgcctccaacccg

SEQ ID NO: 330753 - DNA, 747 bp, Homo sapiens
  misc_feature: GZ8MTXP02IDH82.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgctaccttctctgggttctcactcagcactaggcggtaggtgggtggtggggcgtggactccgtcaccggacccccgaagggaaacggcccgtgggagtggcttcggcactctatttagttggatgatgaataagcgctacacgcccatctctagatagaacgaggctaccaccactaccaaacgaaaccggacccgtaaccctaacccgaaaaacctcgggtaacgttacccttaaacgaaactacgaaacccaaacgtagtaccggacccttaggacgaccaacgaccgaccaactaattaacgttacgtaggtacgaacaacgaacggtaacggaacggtaccggggacaacgggtaccggttaaccggggtttgggggttttaccgggggtaccgttaaaccgggggtccggggggtaaccccggtaacccgggggttaaaccccgttccgggggttaacccccggttaaccccgggtttaccccttcccccggttacccggaacccccggtacccccgtttaaacccccgggtaaaaccccccgggg

SEQ ID NO: 330754 - DNA, 610 bp, Homo sapiens
  misc_feature: GZ8MTXP02I34NR.4.75.G09.1.454.CMB.2.raw
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccagggaacggccctggagtggcttgctactctatttagttgggatgatgataagcgactacacgcctatctctgatgaacaggctcacntacaccaaggaccacctaccgaaaaccgngggtacgtacctaacaactcgaaccaacncgtacggaccctaggtagacacacgacctanattatcgtacgtgacaacgagacgtacgacggggactacgcgttacggggttgggttttacgggggaccgttacgggtaccgggggaccgtaaaccggggtaaccccgttcggggtaacccgtaacccggttccgtacccttaccgaccggtaccccgttaacccgaaccccggg

SEQ ID NO: 330755 - DNA, 542 bp, Homo sapiens
  misc_feature: GZ8MTXP02HMBT8.4.75.G09.1.454.CMB.2.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (448)..(448): a, c, t, g, unknown or other
  misc_feature (448)..(448): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacgccctggagtggcttgcactctatttagttgggatgatgataagcgctacagccctatctctcgatgaacnggctcacntcacaacgaccacctaccaaaacngtcgtacctaacaatcgaaccaanagtcgaccctgacgacacganaccanattatactgtgaccagagagagtccggganagacgtacggtggtcggacgtacggtcgggaccgtacgggtaaccgtcggtaaccgaccgtccgtaccgtccgaccgtacccgtacccgaaccg

SEQ ID NO: 330756 - DNA, 661 bp, Homo sapiens
  misc_feature: GZ8MTXP02FKJVI.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccccgaggaaacggccctggagtggcttgcactctatttagtggatgatgataagcgctacacgcccatctctgatagaacaggcctaccaaccactaccgaacccgaaacgggacccgaccctaaacccaaaaaacccgacgggttaccggttacccttaaacaaacgtacgaaacccaaacgacgtaccgggaaccccttggtacggaaccacgaacgccaaactattaacttacgtgtacgaccgaacgaggaagacgtacggacagcgtaacgggttggggtttcggggaccgttacgggtacgggggaccccgtaaacggggtaacccccgttcgggtaacccgtaccccggttcctaccccgtaccgtaccgtacccccgtacccgaaaacccccgggg

SEQ ID NO: 330757 - DNA, 634 bp, Homo sapiens
  misc_feature: GZ8MTXP02GKV8M.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactctatttagtgggatgatgataagcgactacacgccatctctgatagaacaggcctacaccataccaaccgaaacggacccgaccctaacccaaaaaccgagggttaccgtacctttaaacaactacgaacccaaatacgtaccgaacccgtgtacgacacacgaccaactattatactgtacgacaacaggagacgtacgggacaggccgtaacgggttcgggggtttaggggaccttacggggttacgggggaccccgtaaacgggggtaaccccgttcggggtaacccgtaaccccgggttaccttccccggtaccaccgtaccccgtacccgaaaacccccggg

SEQ ID NO: 330758 - DNA, 634 bp, Homo sapiens
  misc_feature: GZ8MTXP02HKNJO.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaacggcctggagtggcttgcactcatttagtggatgatgataagcgctacacgccatctctgatagacaggctaccacactccaaccaaacggacccgaccctaaccaaaaaccgacgggtacgttaccttaacaacgtacgaaacctaacgacgttcgggaacccctggtacgaccacgtacgaccctaaactacttaacgttacctaggtacgacaaccgaaggacggaacgtaccggggaccaaaggtccgtaaccggttgggggttttacggggaccgttacggtacgggggacccgaacggggtaccccgtacgggtccgtacccggttcctacccgtcggacccgtaccccgtaccgaaaccccggg

SEQ ID NO: 330759 - DNA, 604 bp, Homo sapiens
  misc_feature: GZ8MTXP02F0DXW.4.75.G09.1.454.CMB.2.raw
  modified_base (345)..(345): a, c, t, g, unknown or other
  misc_feature (345)..(345): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggcccgtggagtggcttgcactctatttagtggatgatgatagcgctacacgcccatctctgatagaacaggctcaccntaccaaccgaaacggaccgaccctaaccaaaaaccgtaggtacgtacccttaacaacgtacgaaccaacacgtacggtaccctggtacggacctacacggacccaactacttaacttaccgtagtacgaccacgagaggaacgtaccgggacacggcgtacgggttggggtttcggggacgttacggtcgggggtacccgtacggggtaccccgttggtccgtacccggtctcccgtcgacgccccgtaccgaacccgg

SEQ ID NO: 330760 - DNA, 585 bp, Homo sapiens
  misc_feature: GZ8MTXP02IHOIN.4.75.G09.1.454.CMB.2.raw
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctctggttctcactcagcactagcggagtgggtgtgggctggactcgtcacgccccaggaaacggcccgtggagtggcttgcactcatttagttggatgatgatagcgctacacgcccatctctgatgacagctacacnctcaaccaaggaccaccctaacaaaaccgaggtacgtacctacaaactcgaaaccaanacgtcggaacccgtgtacggaacacaacgacccaactaattattaccgtggtacacaacgaagacgtagtacgggacacggcgtaacgggttggggttcggggacttaaccggcgggggacctaacgggggtaccctggggtaaccacccggtctaccctaccaacccgtaccaacgaaccccggg

SEQ ID NO: 330761 - DNA, 633 bp, Homo sapiens
  misc_feature: GZ8MTXP02IT4ZJ.4.75.G09.1.454.CMB.2.raw
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (524)..(524): a, c, t, g, unknown or other
  misc_feature (524)..(524): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtggtgggctggatccgtcacgccccaggaaagcctggagtggctgcactctatttagttgggatgatgaataagcnctacacgcccatctctgagtagaacacggctaccgaccncgtaccaaccgaaacgggacccgaccctaaccgaaaaaccgtacgggttacgggttaccttaaaccgaaagttacgaaaccctaaacgacgttcccggaccccgttaggtaccggaacaaccgaacgacccaataacttacttacgtgtacgacacgtaagagaacgtacgggangacgtaacggttgggtttacgggcgttaacgggtcggggacccgaacggggtaacccgtcggtaaccgtaccggtacctcccgtacgacctcccgtaccgaaaccccgg

SEQ ID NO: 330762 - DNA, 651 bp, Homo sapiens
  misc_feature: GZ8MTXP02GIWVU.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcactagcggagtgggtgtgggctggatccgtcacgcccccaggaaacggcccgtggagtggcttggctactctatttagttgggatgatgaatagcgctacacgcccatctctgatagaacaggctacaccataccaaccgaacggaccgaccctacccaaaaaccgacggtacgttaccttaaacatacgaaccaacgtacgtacggtacccgtgtacggacacacgaccaactattattactgtacgacaacgagagtaacgacggggactaaggccgtaacgggtttgggggtttacggggtaccgtttaaaccgggggtcgggggtaccccgaaaccgggggtaaccccgttcggggtaacccgtaacccccggtttacccgtcccgttaccgaacccggtccccctttacccggaaaacccccggg

SEQ ID NO: 330763 - DNA, 610 bp, Homo sapiens
  misc_feature: GZ8MTXP02F3HBT.4.75.G09.1.454.CMB.2.raw
  modified_base (458)..(458): a, c, t, g, unknown or other
  misc_feature (458)..(458): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgccccgaggaaacggcccgtggagtggcttgcactctatttagttggatgatgatagcgctacacgccatctctgatacgaacaggctaccaccactaccaaccgaacggaccgaccctaaacccaaaaccgtacgggttacgtacccttaaacaatacgaacccaaacgacgtaccggacctggtacgaccacacgaccctaanacttattactgtacgacacgagagacgtacgggacaggcgtaacggttgggtttacggggacttacggggcggggacccgtaacggggtaccccgttacggtaacccgtacccggttctccccgtacaccggaccctacccgaaaccccggg

SEQ ID NO: 330764 - DNA, 542 bp, Homo sapiens
  misc_feature: GZ8MTXP02HINTW.4.75.G09.1.454.CMB.2.raw
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggtaaacggcccgtggagtggcttagcactctatttagtgggatgatgataagcgctacacgcccatctngatgaacngctacacnctacaaccaaggaccgacctacaaaaccgnggtcgtaccttacaatcgaaccaacngtcgaccctgacgacacagccaanattatacngtgaccagagagagtacggacagcgtacggtgggttcgggactacggtcggggaccgacgggtaaccctgggtccaccggtctacctcgacgtccctaccgaacccgg

SEQ ID NO: 330765 - DNA, 812 bp, Homo sapiens
  misc_feature: GZ8MTXP02I250A.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggttctcactcagcacgtaggcggtaggtgggtggtgggctggactccgtcacgccccaggaacgccgtggagtgctgcactctattagtggatgatagaagtaacgcgtacgtacacgtcctatctctagagtacgaacgcgtactaccaccactaccgaaaccgaacggaccccgtaaccccgtaaacccgaaaaaaccggtcgggttaaccgttaacccttaaacgtaaacgtaaccggaaaaccctaaaccgtacggttacccgggtaaccccgttagggtacccgggaaccaaccgaaaccggacccctaaacttaaacgttttaacctttaacccggttgggttaacccaacccgtaaaggtaaacgggaacggttaaaaccggtccgggggaacccgaacgggttacccggtttaaacgggggtttcgggggttttacccgggggaacccgtttaacccgggggaacggggggtaaccccggtaaaccccgggggtaacccggtttccgggtaaccccgttaacccccgggttccctttacccccggaccgttaacccccggacccccgttaacccccggtaaaaaccccccgggg

SEQ ID NO: 330766 - DNA, 723 bp, Homo sapiens
  misc_feature: GZ8MTXP02FWHWM.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctcgtggttctcactcagcactagcggagtgggtgtgggctggatccgtcgacgccccaggaacgccgtggagtggctgcactctatttagtggatgatgagtagcgctacacgccatctctgatcgaacacggctaccaaccactaccgaaccgaaacgggacccaccctaaacccgaaaaaacccgagggttacgtaccctttaaacgaacgtaacgaaccaaactaacgtaccggacctacgggtacggaaccacgaaccgacccaaactacttaacttacgtacgtacgaccgaacgaggtaacggaaacgtaccggggacgaaggtaccggttaaccgggggtttgggggttttaccgggggtaaccgttaaccgggggttaccggggggtacccccggtaaaaccgggggttaacccccggtttaccggggtaaccccggttaaccccgggttccctttacccccggtaccgaacccccggggtccccctaaccccggttaaaaccccccggggg

SEQ ID NO: 330767 - DNA, 714 bp, Homo sapiens
  misc_feature: GZ8MTXP02FR9V1.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcggccaccctcagtgtccgtgtccccaggacagacagccagcatcagctgctctggagataagttggggataagtatgtttgtggtatcagcagacgcagccacgtcccctgtgctggtcatctattatgaactaccgaacggccgtccctagacggtactcccccgtagacgtcgtactttctccgtcggtccctaccaaacgttcggtaccgggaaaccacgaccgtaccctacttaccgtacgaaccctacgtaccggaaccggggacccggggaaccccgtagggtacccttaagggttacgggaagttacggggaaacggtccgtttaacggttaaacctttaacgtttaaacccgggttggttaacccgggagggggtacccgggttaagggggtaaaccgacggacccgaacggtaccccttaaaaccggtttccccttaaggtttcccggttaccgttccgggaccgtaccggtaccggtaaacccgtaacgggttacccgtacccggttaccggtacggtaccgaacccggaacccgaaaccccgg

SEQ ID NO: 330768 - DNA, 547 bp, Homo sapiens
  misc_feature: GZ8MTXP02ICN80.4.75.G09.1.454.CMB.2.raw
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (525)..(525): a, c, t, g, unknown or other
  misc_feature (525)..(525): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattggatgatgataagcgctacagcccatctctgatgaacaggctcaccntccaccaaaggtaccgccctaccaaaaaccnggtcggtacctacaatcgaccaaacatcggaaccctgtcggacacgagcccacattaattactgtagcacagagagtggacgggcaagccgaggttggggtttcgggcttaacggtcggggacccgacgggaaccctgggtccaacccggttcncccttccgacgtcccaaccccg

SEQ ID NO: 330769 - DNA, 596 bp, Homo sapiens
  misc_feature: GZ8MTXP02JA8AV.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaaggccctggagtggcttgcacgtcatttagtggatgatgatagcgctacacgccatctctgatcgaacaggctacaccagtaccaaccgaacggaccgaccctaaccaaaaaccgacggtacggtacccttaacaaacttacgaacccaaacacgtccggaccctgtacggacacaacgcccaactaacttacttaactggtacgcaacgagagaagtacggggacagcgtacggttgggttcggggcgtacggtacggggaccgaacggggtaacccgttcgggtaaccgtacccggtcctaccgtaccgaccgtccctacccgaaccccgg

SEQ ID NO: 330770 - DNA, 657 bp, Homo sapiens
  misc_feature: GZ8MTXP02H0YG6.4.75.G09.1.454.CMB.2.raw
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggcccctggagtggcttgcactcatttattgggatgatgataagcgctacagcccatctctgatgaacaggctcaccntccaccaaggaccgaccctaccaaaaacctggtacgtacccttaanaatacgaaccaaacatacggaccctaggtacggacaacgacgacccaactattaacttaacgtcgtacgacaacgaggaacggtacgtaaccggggacaacgggaccgttaacgggttcgggggtttttacgggggaccgttaaaccggggttcgggggtaaccccggaaccgggggtaaaacccccgttcggggttaacccgtaaccccgggttcccttaccccgttaccgaacccggtccccctttaaccccgaaaacccccgggg

SEQ ID NO: 330771 - DNA, 602 bp, Homo sapiens
  misc_feature: GZ8MTXP02H5MFL.4.75.G09.1.454.CMB.2.raw
  modified_base (352)..(352): a, c, t, g, unknown or other
  misc_feature (352)..(352): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcagcacgtagcggaggtgggtgtgggctggactcccgtcacgccccgaggaaacggcccgtgggagtggcttgcactctatttagttgggatgatgataagcgactacacgccatctctgatagacagctacacnaccaacaacgaccacctaacccgaaaacgtaggtacctactaacaacgtacgaaccaagtacgtacggacccttaggacgacaaccgacgaccctactaattacttacgagtacgacaacgagtacgaacgtaccggagacgacgtacggttaggggttcgggacgttacgggacggggccgtaccggggtaacctcgggtaacccgtccggtacctacccgtacgaccgtacccctaccgaaaccccgg

SEQ ID NO: 330772 - DNA, 621 bp, Homo sapiens
  misc_feature: GZ8MTXP02FUCJX.4.75.G09.1.454.CMB.2.raw
  modified_base (385)..(385): a, c, t, g, unknown or other
  misc_feature (385)..(385): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccgaggaaacggccgtggagtggcttgcactctatttagttggtatgatgagtaagcgactacacgcccatctctgatagaacaggctaccaccatccaaccgaacgaccgacctaaccgaaaaaccgnggttacgtaccttaacaaatacgaacccaacagtaccggacctgtacgaacacgaacgccaacattacgttactaggtagacccaagaaggagtaacgttaccggggactacggacgtaacgggttggggttttacggggcgttacggtcgggggacccgtaacggggtaaacccgttcggggtaaccctccggttacccttccgtccgaacggccccttacccgaaaaccccggg

SEQ ID NO: 330773 - DNA, 587 bp, Homo sapiens
  misc_feature: GZ8MTXP02HZUXY.4.75.G09.1.454.CMB.2.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggttctcactcagcactagcggagtgggtgtgggntggatccgcacgcccccaggaaacggccgnggagtggcttgctactctatttagttggatgatagataagcgctacacgccatctctcgatagaacacgctacacntaccaacgacgaccgacctaaccaaaacctggtacgtactaacgaatacgaaccaanaacgtcgaccctggacgacacacgtacccaanactttaattacctggtagacccaagaaggagtacgacgggacaagccgtacgggttggggtttacggggactaaggggtcgggacccggtaacgggaaccccgttggaaccgtccggtccgccctcggacctccgtacccgaaaccccgg

SEQ ID NO: 330774 - DNA, 615 bp, Homo sapiens
  misc_feature: GZ8MTXP02HON2N.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaacccacacagaccctcacgctgacctgcaccttctctggttctcactcagcactagcggtagtgggtgtgggctggatccgcacgcccccgaggaaacggcccgtggagtggcttcgctactctatttagttggatgatgtataagcgactacacgccatctctgatagaacacggctaccactactaccaaccaaacggtacccgaaccccttaaaccgaaaaaccgtacgggtaccgttacccttaacaaacttaccggaaacccaaactaggtacccgtacccttggacggaacctaacgacgacccaactaacttattaacgtgtacgacaacaggagacgtacggcaagcgtacgggtgggttacgggtctaacgggtcgggaccgaacgggtacccgtcggtcctacggttccgtcctcgaccgtcccgtacgaaacccgg

SEQ ID NO: 330775 - DNA, 742 bp, Homo sapiens
  misc_feature: GZ8MTXP02F1OHA.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcacgtctatttagtggatgatgataagcgactacacgcccatactctagatagaacacggcctacaaccagtacccaaaccggaaacgggaacccgaccccgttaaaacccgaaaaaaaccgtacgggggttaccggttaacccctttaaaacgaaacgttaccggaaaaccctaaaacgtaaccgttaccgggtaacccccttagggtaccgggaaaccaaccgaacgtacccaaacttaacttacgtttaaacccgtggttaccgaacaaccgaaggaacgtaaacggtaccggggactacggtacgttaaccggggtttggggttttaccgggggacttaaaccggggttcgggggaccccggtaaaaccgggggtaaccccgttcggggtaacccgtaaccccggttaccttccccgttacggacccgtaccccgttaccccgaaaacccccgggg

SEQ ID NO: 330776 - DNA, 621 bp, Homo sapiens
  misc_feature: GZ8MTXP02GQRA3.4.75.G09.1.454.CMB.2.raw
  modified_base (174)..(174): a, c, t, g, unknown or other
  misc_feature (174)..(174): n is a, c, g, or t
  modified_base (594)..(594): a, c, t, g, unknown or other
  misc_feature (594)..(594): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccanacagacctcacgctgacctgcaccttctctggttctcactcagcactagcggagtgggtgtgggctggactccgtcacgccccgaggaaacggcctggagtggcttgcactctatttagtggatgatagataagcgactacgacgccatctctagatagaacgacggcaccaacacaccaaccaaacggaccgaaccctaaaccgaaaaaaccgtaggtacgttaaccttaaacaaacacaaaccaaacgacgtacgaacccgtggacggacacaacgaaccaactaacttaagttaccttggacaaccaagaaggaagaacggacggaccgaagacgtaaccggttggggtttacggggaccgtacgggtacggggaccgaaccggggacccttacggaaccgtacccggtcttacccncaaccgtcccctaacccggaaacccgg

SEQ ID NO: 330777 - DNA, 548 bp, Homo sapiens
  misc_feature: GZ8MTXP02GOJXI.4.75.G09.1.454.CMB.2.raw
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagngctacngcccatctctgatgaacaggctacacatcacaaggacgcctacaaaaaccgnggtacgtacccttaaanaacacgaaccaanagtacgacctgacgacacacaccatatatacgtagtcacanagagagacggacgacgacgtacggtagggttgggtacggtacggtacgggtaccggacggtacccgtacgtccgtacccgtaccgtcctaccgaccgtcccgtaccgaaccg

SEQ ID NO: 330778 - DNA, 674 bp, Homo sapiens
  misc_feature: GZ8MTXP02JXH6M.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcacgcccccaggaaacggccctggagtggcttgcactctatttatgggatgatgataagcgctacagcccatcgtctgatgaacgaggcctacaaccacgtacaacccgaaacgggacccgaccctaaacccgaaaaaacccgcgggttaccggttacccttaaacgaaacttacggaaacccaaacgtacgttaccggaaccccttagggtacgggaaccaacgaacgacccctaaacaattaacttaacccgtggttacgacaacgaagaagaacgtaccgggactaggccgtaacgggttcggggtttggggaccgttaacggttcgggggacccggtaaaccgggggtaaccccgttcgggtaacccgtacccggttccctacccgttaccgaaccgtccccgtacccgaaaacccccggg

SEQ ID NO: 330779 - DNA, 569 bp, Homo sapiens
  misc_feature: GZ8MTXP02JPF8U.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctcgatgaacaggctcacatcacaaggaccacctacccaaaaaccacggtacggtcctttaacaatacgacccaaacgatacggaaccctgtagggaccacgagcccaactatacttaactgtagacacagagatacggggcagcgtacggtgggtttacggggcgttacggtcggggtaccgacggggaaccccttgggtaaccgacccggttctcccgtccgtaccgccctacccgaaaccccgg

SEQ ID NO: 330780 - DNA, 577 bp, Homo sapiens
  misc_feature: GZ8MTXP02G5KAF.4.75.G09.1.454.CMB.2.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (470)..(470): a, c, t, g, unknown or other
  misc_feature (470)..(470): n is a, c, g, or t
  modified_base (560)..(560): a, c, t, g, unknown or other
  misc_feature (560)..(560): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgcccccaggaaaggccctggagtggcttgcactctattagtggatgatganagcgctacacgccatctctcgatgaacaggctcacntaccacgaacggacaccctaaccaaaaccgacggtacgtacctaacatacgacaacgatcggaccctggtacgacacacgtaccactaacttattacgtagtcgacgaaccgaggagtacgtaccggganagacccgtagggttgggttacggggcgtaacgggtcggggacccgtaaacggggcccttacgggccgtacccggtcctcccgtacgaccncccgtacccgaacccgg

SEQ ID NO: 330781 - DNA, 623 bp, Homo sapiens
  misc_feature: GZ8MTXP02IYFVF.4.75.G09.1.454.CMB.2.raw
  modified_base (341)..(341): a, c, t, g, unknown or other
  misc_feature (341)..(341): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaacgcctggagtggcttgcactctattagttggatgatgataagcgctacacgccctatctctgatgaacaggctccaccntccaaccgaaacggaccaccctaaaccgaaaaaccgacgggttacgggtaccctttaacaaatacggaaaccaaacgactcggtaacccctggtacgggaaccacgagacccaactaacttattaccgtgtacgacacgaaggagaacgtacgggacacgccgtagggttgggtttcgggggccttaacgggtcgggggtacccgtaacgggggtaacccccgttcgggtaaccgtaacccggtccttaccccgcgtaacccgtcccgtacccaaacccggg

SEQ ID NO: 330782 - DNA, 707 bp, Homo sapiens
  misc_feature: GZ8MTXP02HXE49.4.75.G09.1.454.CMB.2.raw
  modified_base (343)..(343): a, c, t, g, unknown or other
  misc_feature (343)..(343): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttagttgggatgatgataagcgctacagcccatctctcgatgaacaggctcaccntaccaaccaaacggaccgaccctacccgaaaaaaccgacgggttacggttacccttaaacaaacgttacgaaaccccaaacgtaacgttaccgggtaaccccgttagggtacgggaaccaaccgaacggacccccaaacctaaatttaactttaaaccgttgggttacgaaccgaaccgaaggtaacggaaacgttaaaccgggggcgaacgggaccgttaaccggggtttgggggtttttcgggggaccgttaccggggtacgggggtacccggaacgggggtaaccccgtacggggttaaccccgtaaccggttcccttaccccgttccgaacccggtcccgttaaccccgaaacccccggg

SEQ ID NO: 330783 - DNA, 693 bp, Homo sapiens
  misc_feature: GZ8MTXP02JH2CU.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctcgtaggaagtaagttaaaggttggggaattaaggttattggtttagtggtatcgagcagacgccaggccacgtcccctgtgctggtctatctattatagactaccgacggccgtcctacggaggaccctcccgtagacgtcgtacttccgtcgtcggtcctaccgtacgtacgtacgggaaccacgtacgaccctacgtctacgaaccagttaccgaaccgggcccccgggaaccgtaacggggccttagtcgggaagttacgggacgggtactttacgaaccgtttaacgttaccgttaggtacgtaacggggtcggtaacgggacgacggtaaccgacgggaccttaacccccgttcgttaaccggtttggttaacccgtccgggtaaccgtacccgggttaccgggtaaacccctaaacggggtttccccaaacccggtttccgtacgggtacccgaaacccggtaaaccccccgg

SEQ ID NO: 330784 - DNA, 689 bp, Homo sapiens
  misc_feature: GZ8MTXP02FQM0N.4.75.G09.1.454.CMB.2.raw
  modified_base (334)..(334): a, c, t, g, unknown or other
  misc_feature (334)..(334): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcactagcggagtgggtggtgggctggactccgtcacgcccccgaggaaacggcccgtggagtggcgttgcactctatttagttgggatgatgataagcgctacacgcccatctntcgatagaacaggctacacctactaccaccgaaacgacccgaccctaaacccgaaaaaccgtcgggttacggttacccttaaacaacttacgaaaccctaaacgacgtaccgggtaccctacgggtacggaaacaccgaacgacccaaatacttaacttaccgttaggacgaaccgaaacgagaacggtaaacggtaccgggacgtacgggccgttaaacggggttgggggtttacgggggtaccgtaccggggtaccgggggtacccgaaaccggggtaacccgttcgggaacccgtaacccggttccctaccccggttacgaccggacccccgttaccccgaaaaccccgggg

SEQ ID NO: 330785 - DNA, 608 bp, Homo sapiens
  misc_feature: GZ8MTXP02HTOFP.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgggttctcactcagcactagcggagtgggtggtgggctggatccgtcacgccccccgaaggaaacggcccgtggagtggcttgcactctatttagttgggatgatgaataagcgctacacgccatctctgatagacgacgctaccacactaccaaccaacggacccgaccctaacccgaaaaacctagggtcgtaaccctaacaaatcgaacccaaacgtatccggaccctgacgaacacgacgaccaatattactactgtacacaacgagaagtacgacggacgacgaccgtagggttcgggtttacgggacgtacggggtccggggaaccgaccggtaccccggtacgtaacccgtacccgtaccgtcctaccgaccgtacccctacccgaaaccccggg

SEQ ID NO: 330786 - DNA, 614 bp, Homo sapiens
  misc_feature: GZ8MTXP02F3K7F.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtcgtcccaggacagacagccagcatcagctgctctggagataagtggggataagtatgttgtggtatcagcagaagccaggccagtcccctgtcgctggtcatctattatgactaccgaaacgccgcctcgagggacctcccgtgaagcgtattcctctcggcctccaaacgtccgtaggggaaacacgacgacccactctacgaccatcgacggccgggaaccagggtacctagtcggaagttcggaaggtccgttagaccttaagttacgtacgtcggtaaggtccgggtaggacgaggacaacggtcctaaccttcccgtaagttccggttccctttacgggaccgtaacccggttacggggaaaacccgttaaccgggtaccgtaaaccccggttcccgttaaaacgggtccccgaaacggtaaacccccgg

SEQ ID NO: 330787 - DNA, 566 bp, Homo sapiens
  misc_feature: GZ8MTXP02I3BPP.4.75.G09.1.454.CMB.2.raw
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcatttagtgggatgatgataagcgctacacgcccatctctgatgaacaggctacacntccaaccaaggaccacctaaccgaaaaccgtggtacgtaccttaacaatcgaaccaanacgtcgaccctgtacgacacacgaccaacattacttactggtacacaacgagagactacgggacaggcgtacggttgggtttaggggctaacggtcggggaccgtacggggtaaccctggtaaccgtacccggtctacccgtacgaccgacccgtaccgaaacccgg

SEQ ID NO: 330788 - DNA, 647 bp, Homo sapiens
  misc_feature: GZ8MTXP02IMHB3.4.75.G09.1.454.CMB.2.raw
  modified_base (446)..(446): a, c, t, g, unknown or other
  misc_feature (446)..(446): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcagctgctcgtaggaagtaagttaaaggttgggggaattaaggttagttggttttggtggtatgagcagaacgcccgaggccaccgtcccctggtcgcgtggtctatcttaattatagaactacccgaacggcccggtccctacggacgggtaccctccccgtagacgtcgtactttcctcgtcggtcctacccgacgttcgaacgggtaacaccacgaccctactccgtacgaacccncgtacccgacgggacccgggtaacccaggtaccgtagtggaggtcggacggtcttaacggtactttacgttacgtgtccggagggtcggtaacggacgacgacacgtacctaccttccgtacgttcggtccgttcgaccgtacggtaccggaaccgtaccggccctacccggtacgtaccggtaccgacccgaacccccgg

SEQ ID NO: 330789 - DNA, 655 bp, Homo sapiens
  misc_feature: GZ8MTXP02JZGBX.4.75.G09.1.454.CMB.2.raw
  modified_base (288)..(288): a, c, t, g, unknown or other
  misc_feature (288)..(288): n is a, c, g, or t
  modified_base (347)..(347): a, c, t, g, unknown or other
  misc_feature (347)..(347): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggactccgtcacgccccgaggaacggccctggagtggcttgcactntatttgtggatgatgaatagcgactacacgcccatctctagatagaacaggctacaccnctaccaaccgaacggaccacctaaccaaaaccgtggtacgtaccttaacaacgtacgaacccaaacgtacgtaccgggaaccccttaggtacggaaccaaccgacgacccaactaacttactttacgtagtcgaaccaacgaagaacggacgtacggggacgacggtacgtacggggtttcggggtttacgggggaccttaccgggggtacgggggtacccggaacgggggttaaccccttcgggggtaacccgtaaccccggttccgtccctacccggtaccgtaccccgtaccccgaaaccccggg

SEQ ID NO: 330790 - DNA, 680 bp, Homo sapiens
  misc_feature: GZ8MTXP02GYGZT.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctctatgagctgactcacgccaccctcagtcgtccgtgtccccaggacagacagccagcatcagctgctcgtaggagtaagttaaagttgggggaataagtagttgtttgttggtatcagcagaacgccgaggcctacgtcccctgtcgtcgtggtctattactattagtcgtaactaccgaaacggtccgcccctagacgggtaccctcccgtgacgtcgtacttccttacgcggtacctaccctaaaccgtcgtaacgggaaaccacgaccgtccctaactccgtacgaacccgacgtaccggacgggaccccggggaaccccgtagggtcccgttaaggtacgggtaagttagggaaacgggtcttacggtaacctttagttaaccgttcggcggtaacggggtcggttacggggaacacgggaacgcgtaccctacccgttccgttacgttccgttcgttaccgacgtaccggtacggtaacccgtaacggttccgtacccgttaccggtaccgtaccgacccggtaaacccg

SEQ ID NO: 330791 - DNA, 682 bp, Homo sapiens
  misc_feature: GZ8MTXP02H7WAA.4.75.G09.1.454.CMB.2.raw
  modified_base (184)..(184): a, c, t, g, unknown or other
  misc_feature (184)..(184): n is a, c, g, or t
  modified_base (407)..(407): a, c, t, g, unknown or other
  misc_feature (407)..(407): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctgggttctcactcagcacgtagcggagtgggtgtgggctggatccgtcacgcccccgaggaacggcccgtggagtggcttgcactctatttagtggatgatgagtaagcgactacacgcccatctctgatagacaggctacaccataccgaacaaacggacccgaaccctaacccgaaaaacctcggtaccgttaccctaaanaacgtacgaaacccaactacgtacggaccccgttggacggacaccgaaacgtcccaaactactttaacttaccgttagtacgacaaaccgaaggtaaacgtacggtaaccgggacgacggtaaccggttaccggggttagggggttttaccgggggaccgttaccggggttaccgggggaacccggtaaacggggttaaccccgtagggtaaccccgtaacccgttacccgttcccgtacccgacccggtaccccgttacccggaaacccccggg

SEQ ID NO: 330792 - DNA, 594 bp, Homo sapiens
  misc_feature: GZ8MTXP02HAKMG.4.75.G09.1.454.CMB.2.raw
  modified_base (324)..(324): a, c, t, g, unknown or other
  misc_feature (324)..(324): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggttctcactcagcacgtagcggaggtgggtggtgggctggatccgtcacgccccgaggaacggcctggagtggcttgcactctatttagttgggatgatgataagcgactacncgaccctatctctcgatagaactacggctacacctactccgaaacgaacggaccaccctaaaccgaaaaccgtgggtacgttacccttaacaataccgaaccaaacagtaccggaccttaggacggacacgacgaccaatattacttacgtgtacgacaacgagagacgtaccggcaagccgtaagggtcggggttggcgttacggacggggacccgacggaaccccgttgccgacccgttcgccctacgaccggccctacgaaacccgg

SEQ ID NO: 330793 - DNA, 559 bp, Homo sapiens
  misc_feature: GZ8MTXP02F0QS8.4.75.G09.1.454.CMB.2.raw
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagccccatctcngatgaacaggctacaccatcaccaaggaccgacctaccaaaaaccngggttacgtaccttacaatcgaaccaacagtcgaccctgtacgacacacgaccacatattacctgtacgcacgagaggactacgggaccaggcacggttgggtttacgggccgttacggtcggggacccgacggggaacccttcgggccgtaccggtctacccttccgaccgtccctaccgaaccccgg

SEQ ID NO: 330794 - DNA, 548 bp, Homo sapiens
  misc_feature: GZ8MTXP02IZ0XX.4.75.G09.1.454.CMB.2.raw
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacagcccatctctgatgaacagctacaccatcaaccaaggaccgcctaacaaaaaccgnggtacgtaccttaacaatacgaaccaacatcggacctggtacgacacagcccanatattacngtagacacagagagtacggcagctacggttggtttacggggcttaacggtcggggaccgaacggggtaacccttggtaacgacccgttctccctcgaccgtccaccgaaacccgg

SEQ ID NO: 330795 - DNA, 496 bp, Homo sapiens
  misc_feature: GZ8MTXP02JJQVA.4.75.G09.1.454.CMB.2.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcagcccccaggaaaggccctggagtggcttgcactcatttattgggatgatgataagcgctacagcccatctctgatgaacagctcacntcacagacgctacaaaacngtgtcctanatnacaacatggacctgngacnacgcacatatactgtncananagtanacggganagcgtacggtggttgggctacggcgggaccgacggaccgtggtaacgaccgtctccacacgaccgaccgaccg

SEQ ID NO: 330796 - DNA, 647 bp, Homo sapiens
  misc_feature: GZ8MTXP02HNPOQ.4.75.G09.1.454.CMB.2.raw
  modified_base (295)..(295): a, c, t, g, unknown or other
  misc_feature (295)..(295): n is a, c, g, or t
  modified_base (521)..(521): a, c, t, g, unknown or other
  misc_feature (521)..(521): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggttctcactcagcactagcggaggtgggtggtgggctggactccgtcacgaccccgaggaacggccgtggagtggctgctactntatttagtggatgatagataacgcgactacacgcctatctctgatagaacgacgctacacactaccaaccgaacgaccgtaccctaaaccgaaaaccgtacgggtaccgttaccttaaacaaagttacgaaacccaaactacgtaccgggacccgttaggacgaaccacgaccgtaccaaatactttaacgtcgtagtacgaaccagaagaacggtacggtacggngacggacggttcgggttacgggggtttacgggacggtttacgggaccggggtaccgaaaccggggtccgtacgggtaacccgtacccgtcgttacccgacgaccgtaccccgttaacggaacccgg

SEQ ID NO: 330797 - DNA, 610 bp, Homo sapiens
  misc_feature: GZ8MTXP02ISRMN.4.75.G09.1.454.CMB.2.raw
  modified_base (396)..(396): a, c, t, g, unknown or other
  misc_feature (396)..(396): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtctgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctggagtggcttgcactcatttagtgggatgatgataagcgctacacgccccatctctgatagaacaggctacaccatcaaccgaaacggaccgaccctaaccaaaaaccgtggtacgtacctaaanaactacgaaccaaacacgtcggaaccctggtacggaccaacacgacccaactaacttaacttactagtacgacaacgaagagaacgtaccgggacagacgtaacggttgggtttcggggacttacggtcggggacccgtaacggggtaaccccgtggggtaaccctaacccggtccttcccgaccgtacccgtaccccgtacccgaaaccccgg

SEQ ID NO: 330798 - DNA, 514 bp, Homo sapiens
  misc_feature: GZ8MTXP02IJJBQ.4.75.G09.1.454.CMB.2.raw
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (429)..(430): a, c, t, g, unknown or other
  misc_feature (429)..(430): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcatttattgggatgatgataagcgctacagcccatctctgatgaacagctcacccatcaaccaaaggacgaccctacaaaaaacgagtagtaccttacaaatgaacaaacatcggaccttgngacacanccaacatattacngtnnacagagagacggacagacacgtggttggggtcgtacgtacgggcgacggaaccgtacgtcgaccgtctcctccncnccaccacg

SEQ ID NO: 330799 - DNA, 606 bp, Homo sapiens
  misc_feature: GZ8MTXP02IZUTD.4.75.G09.1.454.CMB.2.raw
  modified_base (314)..(314): a, c, t, g, unknown or other
  misc_feature (314)..(314): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaacggcctggagtggcttgcactctattagttgggatgatgataagcgctacncgccatctctgatgaacaggctacaccatccaaccgaaaggaccgaccctaaccaaaaaccgtaggttacggtaccttaacaatacgaacccaatagtcggaccctgtacgacacacgaccacattacttactgtacgacacgagtacgaacgacgggacacggcgtaacgggttggggtttacgggggaccgttacgggtacgggggtacccgaaaccgggggtacccgttacgggtaacccgtaaccccgttcgtacccctacgaacccgtcccgtacccgaaacccggg

SEQ ID NO: 330800 - DNA, 592 bp, Homo sapiens
  misc_feature: GZ8MTXP02IECCO.4.75.G09.1.454.CMB.2.raw
tcagagcactgtagcacgaccggtgctcgatttagtatagacatcagggtcttcgtgactcctgtgccccaccatggacacacttttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggactccgtcacgcccccgaggaaacggccctggagtcggcttgcacgtctatttagttgggatgatgataacgcgactacagccatctctgatagaacaggctacacactaccaccgaaacggaccaccctaaacccgaaaacctacgggtacgttacctaacaaacgtacgaaacccaaacacgtacggaccctaggtcggaacacaacgacccaactaattactactgtacacacgagagacgtacggcagcgtaggttgggttgggctacgggtcgggacccgacggggtaccctggtaacccgtccggtacctccgtaccgaccgacccgtacccgaacccgg

SEQ ID NO: 330801 - DNA, 648 bp, Homo sapiens
  misc_feature: GZ8MTXP02HYSNC.4.75.G09.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcagctgctctggatataagtggggaataagtnttgtttgtgtatcagcagagccgaggccacgtccccgtgtgctggtcattctaattagngtaactaccgaacgccggtaccctagacgggttaccctcccgtagacgcgtactttccgtcgtggcctacctacgtcgtacgggaacacgacgtccaacgtctagaccatccgacggccgggacctaggcctagtcggaacgttggagtcgttagtaacgttacttacgtcggtacgacggggtacggtacgggaaccgaggtcaccggtaccttaacccgtttcccgttagttcggttacccgttccgggaaccgtaacccgggtttaaccgggaaaacccggttacccggttacccgtaacccccgggtttacgaaaccgggttacccgaacccgggtaaaacccccgg

SEQ ID NO: 330802 - DNA, 529 bp, Homo sapiens
  misc_feature: GZ8MTXP02GKOZJ.4.75.G09.1.454.CMB.2.raw
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttatgggatgatgataagcgctacagcccatctctgatgaacaggctcaccntcaccaaggaccnccctaaccaaaaaccaggtacggtacccttaacaatacggaaccaaacacgtcggaacccctgtacgggaccacaagccaacataattacngtgcacagagagtacggacagcaggtcgggttgggctacgnggggccacgggaccnggtcaccggtcncctcacgcctcgaaccg

SEQ ID NO: 330803 - DNA, 770 bp, Homo sapiens
  misc_feature: GZ8MTXP02GBHQ4.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactctatttatgggatgatgataagcgctacacgcccatctctgatgaacaggctacacagtcaaccgaaacggaccgaccctaaccgaaaaaaccgtagggtacgtaccctttaacgaaactacgaaaccctaaacacgtcggtaaccccgttagtacgggaaccaaccgaaacggaccccaaacttaaactttaaacgtttaacccgtttagggtacggtaaaccctaaaccgtaaacggtaaacggaaacggttaaccgggggaccctaaacggggtacccgttaaacccgggggtttgggggtttttaaccggggggacccgtttaaaccgggggttaccgggggggaacccccgtaaaaccggggggtaaaacccccccggtttgggggttaacccccgtaaaaccccggggttttccccttacccccggttaccgaaacccggtacccccgtttaacccccggtaaaaacccccccggggg

SEQ ID NO: 330804 - DNA, 685 bp, Homo sapiens
  misc_feature: GZ8MTXP02HVR70.4.75.G09.1.454.CMB.2.raw
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgttggttctcactcagcacgtaggcggaggtgggtggtgggcgtggagtcccgtcaccgacccccgaagggaaacggcccgtgggagtggcttgcactctatttagttggatgatganaagcgctacncgcctatctntcgatagacgacgctaccacnctaccaacgaacggaccctaccctaaacccgaaaaccgtacgggtaccgttacctaactaactacgaaaccaaacgtacgtccggtaaccctggtacgaacacctaacgcctaataatttacttacgtggtacacgaaacgaaggagtaacggtaccggaacgtacggtaccggttacggggttcgggggttttacgggggaccgttacgggggtaccgggggaacccggtaaccgggggttaaccccgtcgggtaaccccgtaccggttacccgttcccgtaccgaccccgtacccgttaccccgaaaaccccgggg

SEQ ID NO: 330805 - DNA, 656 bp, Homo sapiens
  misc_feature: GZ8MTXP02F2ZCA.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacggccctgggagtggcttgcactctatttagtgggatgatgataagcgactacacgcccatctctgatagaacagctaccacataccaaccgaaaggacccgacccctaacgaaaaacccgtagggtacggttacccttaacaaatacgaaacccaaacacgtccggaccgtagtacggaaccacacgacccaaacgtattattacctggtagaccagaggaacgaacgtaccgggggacaggtccgtaacggggtttcgggggtttagggggacccgttaacgggtaccggggggtacccgaaaccgggggtacccccgttaggggtaaccccgtaacccgggttcccttacccccgtcgtaaccgacccccgttaccgaaacccccggg

SEQ ID NO: 330806 - DNA, 725 bp, Homo sapiens
  misc_feature: GZ8MTXP02FWXZN.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgcccccgaggaaacggccctgggagtcggcttgcactctatttagttgggatgatgataagcgctacacgccatctctgatgaacacggtctaccaaccactaccaaacccgaaacgggacccgaacccttaaacccgaaaaaaccgtacgggttacggtaccctttaaaccaaacgtaccgaaacctaaaccgtaacgtaccgggtaacccgttacgggtacgggaaccaaccgaacgaaccctaactaaactttaactttaccgttaggtacgaccgaacgaaggaacgtaacggtaccggggacgtaacgggtaccgtaacggggtttcgggggtttacgggggtaccgttacggggttaccggggggaccccgtaaacggggggtacccccgttacgggttaaccccgtaacccggttccccgttacccgttaccgacccgtaccccgtaccccgaaaaccccgggg

SEQ ID NO: 330807 - DNA, 700 bp, Homo sapiens
  misc_feature: GZ8MTXP02H9GV1.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgctaccttctctggttctcactcagcactaggcggaggtgggtgtgggctggatccgtcacgcccccagggaacggccctggagtggcttgcactcatttagtggatgatgataagcgactacgacgccctatctctgatagaacaggctcaccataccaaccgaaacggacccacccgtaaaccccaaaaaccgtagggttaccggttaaccctaaacgtaaacgtaccggaaaccctaaactaacgtaccggtaccccgtaggtaccgggaccaaccgaaccgacccaaactactttaacgttacgtacgtacgaccaaacgaaggacggaacggttaaccgggacgtaaacgtaccggttaacggggttcgggggttttacggggacccttacgggggttaccgggggacccggtaccggggtaaaaccccgttcggggtaaccccgtacccggttccttaccccgaccgtacccgtaccccggttacccaaacccccgggg

SEQ ID NO: 330808 - DNA, 604 bp, Homo sapiens
  misc_feature: GZ8MTXP02I70ZF.4.75.G09.1.454.CMB.2.raw
  modified_base (424)..(424): a, c, t, g, unknown or other
  misc_feature (424)..(424): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaaacggcctggagtggcttgcactctatttagttgggatgatgataagcgctacacgcccatctctgatacgaacacggctaccaccactaccaaccgaaacggaccgaccctaaccgaaaaaccgtgggtacgtacctttaacaacgtacgaaacccaanacgtccggaacccgtggtacggacacacgaccaactattactactgtacgacacaggacgacgacgggacacggcgtacgggttcgggtttcggggaccgttacggtcggggaccgaaccgggaacccgttcggaaccgtacccgtctcccgtacgaccgtcccgtacccgaaacccggg

SEQ ID NO: 330809 - DNA, 652 bp, Homo sapiens
  misc_feature: GZ8MTXP02I1NF5.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaaggccctggagtggcttgcactcatttatggatgatgaatagcgactacacgccatctctgatagaacaggctacaccactacaaccgaaaggaccaccctaaaccgaaaaaccgacgggtacggttacccttaaacaaactacggaaacccaaacgacgttacgggaaccccttagacgggaaaccacgaacgacccaataaacttaattaacgttcgtacgccaagaagacgaaagttaccggggaccaaagcccgaaacgggtttgggtttacgggggacgttaaaccggtacgggggtacccggaaaccggggtaaaccccgtcggggtttccaaccccggttcctacccgtaccggacgacccccttacccgaaaacccccggg

SEQ ID NO: 330810 - DNA, 720 bp, Homo sapiens
  misc_feature: GZ8MTXP02GSTU5.4.75.G09.1.454.CMB.2.raw
  modified_base (357)..(357): a, c, t, g, unknown or other
  misc_feature (357)..(357): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctggttctcactcagcactagcggaggtgggtgtgggctggactccgtcacgaccccgaggaaacgcccgtaggagtggcttgcacgtctatttagtggtatgatgatagcgactacgacgcctatctcgtgatagaacgacgtctaccacnctaccgaaccgaaccggacccgaccctaaaccgtaaaaccgcggttacgtaccttaacaactacgaaacctaagacgtccgaccgtaggtacgaacacgtaacaccgtaaactacggtttacttaccgttagtaccggtaacaacggtaaccggaaggttaaaccggtaaccggggacgtaacgggtacccggtttaaacgggggtttacgggggtttccgggggtaaccgtttacccgggggtacgggggttacccccgggaaaccggttaaaccccggttccggggtaacccgttaacccccgggttcctacccgggttaccaccccgggtaccccgtttaaccccggtaaacccccgggg

SEQ ID NO: 330811 - DNA, 566 bp, Homo sapiens
  misc_feature: GZ8MTXP02JG8QX.4.75.G09.1.454.CMB.2.raw
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatcccgtcacgcccccaggaaacggccctgggagtggcttgcactcattattgggatgatgataagcgctacacgccatctctgatgaacaggctacaccatccaaccaaacggaccgaccctaccaaaaaccgnggttacggtacccttaacaatacgacccaacatacggaccctgtgacacagccanatatactgtacgcacgagagactacggggacacgcgtacggttgggtttggggccgttaacggtcgggggaccgtaacggggaacccctggtccgacccggtcctaccgtcaaccgcctacccaaacccgg

SEQ ID NO: 330812 - DNA, 619 bp, Homo sapiens
  misc_feature: GZ8MTXP02H2TNK.4.75.G09.1.454.CMB.2.raw
  modified_base (316)..(316): a, c, t, g, unknown or other
  misc_feature (316)..(316): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctgggttcctcactcagcacgtaggcggaggtgggtggtgggctggtactcccgtcgaccgaccccccgaagggaaaccggcccgtgggagtcggtcttgacctacctntatttagttgggatagatgaataagcactacacgaccctatctacgtagatacgaacgacgtctaccacctctacccaaaccgaaccggacccgtaacccctaaaccgaaaaccgtacggggttaccgtaccttaacaaacgtacgaaacacgtagtaccggactaggacgacacgtacncctaatactattacgngacacagagtacgacgtacggcagtcggttacgggtgggtacggacgtacgggacggaccgaccggtaccgtcgtcccgccgtacctcgccgaccgcctacccgacg

SEQ ID NO: 330813 - DNA, 519 bp, Homo sapiens
  misc_feature: GZ8MTXP02ITA6K.4.75.G09.1.454.CMB.2.raw
  modified_base (217)..(217): a, c, t, g, unknown or other
  misc_feature (217)..(217): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataaattggggataagtatgtttgtggtatcagcagaagccaggccagtcccctgtgctggtcatctattatgataccaagcgccctnagggactccctgancgtatctcnggctcgaactgtcgggaacncgagaccatcctgaccatcagcgggacccagctagngangagngtnactntactgtcgaggcgtacggacacgacacgtacctacgtacctacgtacgttccgttcggacctacggtacggaaccgtaacggtaccgtacccggttaccgtaccggtacgaaccgaccccg

SEQ ID NO: 330814 - DNA, 672 bp, Homo sapiens
  misc_feature: GZ8MTXP02FMRK5.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgccccaggaacggccgtggagtggcttgcactctattagtggatgatgatagcgctacacgccatctctgatacgaacacggctaccaacctactaccaaaccgaaacggacccgtacccctaaaccgaaaaaccgacgggttacgttaccctttaaacaaacgttaccgaaacccaaacgtacgtaccgggtaacccccttagggtacggaaaccacgaaacgacccaaactaattaactttaccgtagtacgaacccaaggaaggtaagaacggtaccgggacgacggtaccgtacgggtttgggggttacggggaccgttacggggtccggggaccgtaaccggggtaaccccttggggtaaccctacccggtcctacccgtaccgaaccggttaccccgacccgaaaccccgggg

SEQ ID NO: 330815 - DNA, 646 bp, Homo sapiens
  misc_feature: GZ8MTXP02HKTBG.4.75.G09.1.454.CMB.2.raw
  modified_base (347)..(347): a, c, t, g, unknown or other
  misc_feature (347)..(347): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctctgggttctcactcagcacgtagcgggaggtgggtggtggggcgtggactccgtcacggcccccaagggaaacggccctgggagtggcttgcacttctatttagttgggtatgatgaataagcgactacacgccctatctcngatagaacacgctacaccataccaaccgaaacggaccctaccctaaaccgaaaacgtacggtacgttacctaaacgaatacgaaccaaacgtacgtacggaccctaggacggacacgacgaacccaatactttaacttactaggtacacaacgaaggaagaacgtacgggacgaacggtcccggtaaggggtttcgggggttacgggggaccgtttacggggcgggggacccgaacggggtacccgttggtaacccgtcccgtcttacccgtaccacggccccttaccgaaccccgggg

SEQ ID NO: 330816 - DNA, 662 bp, Homo sapiens
  misc_feature: GZ8MTXP02FHQA3.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtggtggggctggatccgtcacgcccccgaggaaacggcccgtgggaggtggcttgcactctatttatgggatgatgatagcgctacacgccatctctgatagaacaggcctaccaacctataccgaaaccgaaaggtacccgaaccctaaacccaaaaacccgtacgggttacgtacccttaaacaaactaacgaacccaaacgacgtacggacccgtagggtacggaaccaacgacgacccaactacttaacgtttactaggtacgcccgaaagaggaaggtaacgtaccgggacgacgacgtaacgggttcggggttcgggggtaccgtacgggtacgggggacccgggtaaccggggaaacccgttcgggcccgtaccggttccctacccgttaccgacccgacccgtacccgaaacccccggg

SEQ ID NO: 330817 - DNA, 660 bp, Homo sapiens
  misc_feature: GZ8MTXP02G74D9.4.75.G09.1.454.CMB.2.raw
  modified_base (283)..(283): a, c, t, g, unknown or other
  misc_feature (283)..(283): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttcgtcccagatcaccttgaaggagtctggtcctacgctggtacgaaacccacacacgaccctcacgctcgacctgcctaccttctcgtggttctcactcagcacgtagcgggtagtgggtggtggctggactccgtcaccgccccgaaggaacgccgnggagtgctgctactctagtttagtggatgatgaatacgccgactacacgccagtctgcgatagaacacgctacaacactaccgaaccgaaacggacccgaaccctaaaccgaaaaccggtcggttaccgttaaccctaacgaaacgtaccgaaacctaaacgaacgttcccggaacccgttaggacccgaacaccgaaccgacctaaactactttaacttacgttaggacaccgaagacggtaacgaaacggtccggacgtacgtacggtacggggttggggtttacgggacccgttacgggacggggacccgtaccggtaaccgttcgaacccgtacgttccctcccgacgacccttcccgaaccgtaacccgggg

SEQ ID NO: 330818 - DNA, 651 bp, Homo sapiens
  misc_feature: GZ8MTXP02GWY2A.4.75.G09.1.454.CMB.2.raw
  modified_base (297)..(297): a, c, t, g, unknown or other
  misc_feature (297)..(297): n is a, c, g, or t
  modified_base (507)..(507): a, c, t, g, unknown or other
  misc_feature (507)..(507): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcctaccttctctggttctcactcagcacgtaggcgggtaggtgggtggtgggctggactccgtcacgccccgaggaacggccgtggagtggctgctactntattagttggatgatagataacgcgctacgacgaccatctctacgatacgaacgacgctaccaacctctacccgaaacgaaccggacccgtaaccctaaacccgaaaaccggtacgggttaaccgttacccttaaaggaactaccgaacccaaacgtaacgttccggaacccttaggacgaaccacacgtacctaaatacttacttacgnggtacaccaagaggaagtacgccggagacggtcggtacgggttggggttaccgggaccgtttacggggaccggggaccgacggggtaacccttcgggaaccctacccggtctcccgtacgcccgtacccgaaccgaaccccggg

SEQ ID NO: 330819 - DNA, 618 bp, Homo sapiens
  misc_feature: GZ8MTXP02GEZHG.4.75.G09.1.454.CMB.2.raw
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcctaccttctctgggttcctcactcagcactagcggagtgggtgtgggctggactccgtcacgccccaggaaacggcctggagtgcttgcactctattagtggatgatgatagcgctacgacgcctatctcngtatgaactcgctaccaccntaccaacgacgaccgacctaaccgaaaacgnggtacgtaccttacaatacgaaccaanacgtcgacccgtagagaccacgacgaccactactacttatgtacacacgagacggtaacgacggtacgacggtacgtacgggtttcggggttacgggggcgttacgggtaccggggacccggtaaaccggggtacccgttacgggtaacccgtaccccggttccgttaccccgaccggtaaccgttacccccgaacccgtaaacccccgggg

SEQ ID NO: 330820 - DNA, 635 bp, Homo sapiens
  misc_feature: GZ8MTXP02I9QMW.4.75.G09.1.454.CMB.2.raw
  modified_base (353)..(353): a, c, t, g, unknown or other
  misc_feature (353)..(353): n is a, c, g, or t
  modified_base (515)..(515): a, c, t, g, unknown or other
  misc_feature (515)..(515): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctgggttctcactcagcactagcggagtgggtgtgggcgtggactccgtcacgccccgaggaacggccgtggagtgcttgctactctagtttagtggatgatagaatagcgctacacgcctatctcagatacgaacgacgctaccacnctaccaaccgaacggacccacctaaaccaaaaccgtacgggttaccgttacctaaacgaagtaccgaaaccaacgacgttccggaaccctggtacgaaccaccgaacgcctaaactaatttacgttaacccgtggtacaccgaagagaggacgtaaccgggntaacggcgttaacgggttgggttcgggacgtaccgggtcgggggaccgaaccggggtcccgtacggtaacccgtacccggtaccgttcccgctaacccggtccgtaacccgaaacccggg

SEQ ID NO: 330821 - DNA, 566 bp, Homo sapiens
  misc_feature: GZ8MTXP02FOF0R.4.75.G09.1.454.CMB.2.raw
  modified_base (339)..(339): a, c, t, g, unknown or other
  misc_feature (339)..(339): n is a, c, g, or t
  modified_base (464)..(464): a, c, t, g, unknown or other
  misc_feature (464)..(464): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgccccaggaacgcccgtggagtggcttgctactctatttagtggatgatagaatacgcgactacacgccctatctctgatagaacngctacacgctaccaacgaacgaccgacctaaccgaaaacgcggtacgtaccttaacatacgaaccaactactcggacctgtcgacacacgaccatatatacgtgtacacacgagagagtacggancgacgtacggttgggttcgggtctacgggtcgggacccgtaacgggtacccgtaggtcccgtaccgttccgtccgtacgtaccgaccctacccgtaacccgg

SEQ ID NO: 330822 - DNA, 685 bp, Homo sapiens
  misc_feature: GZ8MTXP02I0RZA.4.75.G09.1.454.CMB.2.raw
  modified_base (293)..(293): a, c, t, g, unknown or other
  misc_feature (293)..(293): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcctaccttctctggttctcactcagcacgtagcggtaggtgggtggtgggcgtggactccgtcacgccccgaggaacggcctggagtgctgctactntattagtggatgatagatacgcgctacacgcctatctctcgatacgaacagtcctacaccactaccgaaaccgaaacggacccgaccctaaacaaaaccgtcggttacgtaccttaaagaactacgaaacccaacgtacgtaccggaccgtagtaccggaaacacgaacgacccctaaagaactttacgttacgtacggtacgaacctagaaacgaggttaaacgaccgggtacgaacggtaccgttacgggggtttacggggttacgggggtaccgttaacggggtcccgggggtaaccggtaaaccccggggtaccccgttagggtaacccccgaaccggtttccctacccgtacggaaccccgtccccgttaacccggaaacccccggg

SEQ ID NO: 330823 - DNA, 690 bp, Homo sapiens
  misc_feature: GZ8MTXP02HVU8R.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctcgtggttctcactcagcacgtaggcggaggtgggtggtggggcgtggatccgtcacgccccgaggaacggcccgtaggagtgcttgctactctatttagtggatgatgagagcactacacgcccatctctacgatagacacggctaccaccataccaaacaacggaccccgaaccctaaacccgaaaaaccgtacgggtaccgttacccttaaacgaactacgaaacccaaacgtacgtaccgggtaaccctacggtacgggaaccacgaaacggtacccaataaactttacgttaacgtacgttacgacgaacgaacggtaaaggtacggtaacggggaccgaacggaccggttacggggtttacgggggtttacgggggtaccgtacggggttaccgggggacccggtaaccggggtaaccccgttcggtaacccgtaccgtccctttccgacccgtacccgtacccgtacccgaaaccccgggg

SEQ ID NO: 330824 - DNA, 615 bp, Homo sapiens
  misc_feature: GZ8MTXP02G43AY.4.75.G09.1.454.CMB.2.raw
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtcccgtcgtccccaggacagacacgccagcatcagctgctacgtggaagtagttaaaggtggggaattaaggttagttggtttgtcggtatacagacgaagacgccgacgcctaccgtcccgtgtcgcgtggtctattacttaagtagtagtaaacctaaccggacggtccggtacccctacggacggtaccccttcccgngacgtcgtacttccgttcgcgtcctaccgtaactaccgtaggaaccacnccgaccncgttaccgacgacctanaccggacggcccgggaacccgagtcctaggtacgagtgggacggtactagtacctttagttacgtggaacggtggtccggaggaccaggtacaccggtctaccgtctacgtcgtacgtcgctacggacgaacgagtcccgacgtacgtacgcccgacgaccccg

SEQ ID NO: 330825 - DNA, 712 bp, Homo sapiens
  misc_feature: GZ8MTXP02GZWLO.4.75.G09.1.454.CMB.2.raw
  modified_base (271)..(271): a, c, t, g, unknown or other
  misc_feature (271)..(271): n is a, c, g, or t
  modified_base (315)..(315): a, c, t, g, unknown or other
  misc_feature (315)..(315): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcacgccccaggaacggcccnggagtgcttgcactctatttagtggatgatagataagcgctacncgcctatctctcgatagaacacggctaccaccacgtaccaaaccgaaacggaccgacccctaaaccgaaaaacccgtagggttacgtacccttaaacaaacgtacgaaacccaaacgacgttaccggacccgtagtacgggacaaccacggaccctaaacacttaacttaccgtaggtacgaccgaaacgaaaggtaacgtaaacggaccggggaccgtaacggtacccggttaacgggggtttacgggggttttacgggggtaacccgttaaccgggggttaccgggggaccccggtaaaccgggggtaaaccccccgggttgggtaaccccgtaccccgttaacccgttccccgtacccggtacccgtacccccgtaccccgtaaaacccccggg

SEQ ID NO: 330826 - DNA, 740 bp, Homo sapiens
  misc_feature: GZ8MTXP02JEPBG.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaacggcctggagtggcttgcactctatttagtggatgatgataagcgctacacgccatctctagatacgaacacggctaccaccactaccaaccgaaacggacccgaccctaaacccgaaaaccgtacgggttacgttacccttaaacaaacgtacgaaaccctaaacgtacgtacccggtaacccgttacgggacggaaaccaaccgaaaccgaccctaaacgttaacgtttaaactttacccgttaggtaccgaccgtaacgaagggaacggtaacgggtaacccggggacgaacggtaccggttaacgggggtttcgggggttttacgggggacccgttaaacgggggttcccggggggaaacccccggtaaaccgggggtaaacccccgttcggggttaaccccgtaacccccggtttacccgtccccgttaccgaccccggttacccccgtaacccggtaaaacccccgggg

SEQ ID NO: 330827 - DNA, 682 bp, Homo sapiens
  misc_feature: GZ8MTXP02GRRHR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcacgtagcggagtgggtggtgggctggatccgtcacgcccccgaaggaaacggccctggagtggcttcgacactctatttagttggatgatgataagcgctacacgccatctctgatacgaacacggctaccaaccactaccaaaccgaaacggacccgaccctaaacccgaaaaaccgtacgggtacgtacccttaaacgaaactacgaaacccaaactacgtaccgggtaccctaggtacggaaccaccgaacgaccctaataacgtttaacttacgtgtagaccgaacgaagaagaacggtacggacgacgtacggtaacgggtttggggtttacggggtaccgttaaccgggttcgggggaccccgtaaccggggtaaaccccggttcggtaacccggttaacccgttccgttaccccgtaccggacccggttacccccgtacccggtaaaacccccggg

SEQ ID NO: 330828 - DNA, 614 bp, Homo sapiens
  misc_feature: GZ8MTXP02IC6P0.4.75.G09.1.454.CMB.2.raw
  modified_base (343)..(343): a, c, t, g, unknown or other
  misc_feature (343)..(343): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtgtgggctggatccgtcagcccccaggaaaggccctggagtggcttgcactcatttattgggatgatgaataagcgctacagcccatctctgatgaacaggctcaccntaccaacaacggaccgacctacccaaaaacagtacggtaccttacaactagaccaaacagtacggaccctgacggacaacgagacccaacaattattaactgtacgcaacgaagacgaacgtacggggacacggaccctagggttacggggtttcgggggacttaccgggtacgggggacccgaaaccgggggtaccccgttacgggtaacccgtaacccggttcccttacccgtacccggtacgtaccccttaccccgaaaacccccggg

SEQ ID NO: 330829 - DNA, 698 bp, Homo sapiens
  misc_feature: GZ8MTXP02HN8YW.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaaggaaacggcccgtggagtggcttgcactctatttagtgggatgatgataagcgactacacgcccatctctgatagaacaggtctacacatccaacaacggaccaccctaacaaaaaccgtggtacgtaccttaacaatacgaaccaaacgtaactcggaaaccctgtaggaacccgaacaacgaccctaacgtaacttaatttaaccgtgggttaagaccaaaccgtaggaaacggacgttaaccgggggacgtaacggacccggttaaaggggtttccgggggttttagggggacccgttttaaaccggggtaccgggggtacccgaaacccgggggttaaacccccgttgggggtttaaccccgaacccccggggtttaccgtttaccccccgtacccggtaacccggacccccgtttaaccccgaaaccccggg

SEQ ID NO: 330830 - DNA, 621 bp, Homo sapiens
  misc_feature: GZ8MTXP02HCRZN.4.75.G09.1.454.CMB.2.raw
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (596)..(596): a, c, t, g, unknown or other
  misc_feature (596)..(596): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccgaggaacgcccgtggagtggcttgcactctatttagtggatgatgatagcgctacncgcctatctcngatacgaacgacgacctaccaacctactaccaaaccgaacggacccgaaccccgttaaacccgaaaaaccggtcgggtaccgttacccttaaaccgaatacggaaccaacgacgtacgacccgtggacgaccacgacacctaatacttactacgtggtacacgagaggagtacgtacggacagtccgtagggttcgggtttgggaccgttacgggcggggtacccgaacgggtaacccgtttcggaacccgtccgttccctacccgttacncccgtacccgtacccgaaacccggg

SEQ ID NO: 330831 - DNA, 747 bp, Homo sapiens
  misc_feature: GZ8MTXP02IU74Y.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgggttctcactcagcactagcggagtgggtgtgggctggatccgtcacgcccccaggaaacggccctggagtggcttggcactctagtttagtggatgatagataagcgctacacgccctatctctgatagaaacacggctacaaccataccaaaccgaaacggaccgaccctaaccaaaaaaccgagggttaccgtaacccttaaacgaaactacggaaacccaaacgtacgtacggaaccccttggacgggaaccaaccgtaacgacccaaactaaacttaacgtttaactacggttacgaccgaaaaccgaaggtaacggtaaaccggtaaccgggggtaccgaaacgggtacccggttaaaaccggggttttacgggggtttcggggggtacccgttaaaaccggggttcggggggtaaccccggaaaacccgggggttaacccccgttacggggttaacccccggtaaccccggtttcccgttaccccgtttaccgaacccggttacccccgtaccccgtaaaaaccccccggggg

SEQ ID NO: 330832 - DNA, 678 bp, Homo sapiens
  misc_feature: GZ8MTXP02F1XC4.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctgggttctcactcagcactagcggagtgggtgtgggctggatccgtcacgccccgaggaaacggcctgggagtggtctgcactctatttagtggatgatgataagcgctacgacgccatctctgatcgaaactaggctacgacctactaccaaccgaaacggaacccgaccctaaacccgaaaaaccgagggttaccggttaccttaaaccaaacgtaacgaacccaaactacgccggtaacccctaggtacggaaccacgaaacacccaaactaatttaacttacgtgtacgacccgaagacgaagtaagaccgggacgacggacgtacgggttggggtttacgggggcgtaaaccggggtcgggggtacccggtaaccggggtaaccccgttaccggggtaacccgttaacccgtcccggttaccccttacccggaaccgtcccccgttaacccgaaaacccccgggg

SEQ ID NO: 330833 - DNA, 715 bp, Homo sapiens
  misc_feature: GZ8MTXP02GC2HL.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgccccaggaaacggcctggagtggcttgcactctatttagtgggatgatgagtaagcgctacgacgaccatctctgatagaacaggctaccaacactaccaaaccgaaacggaacccgaccctaaacccgaaaaaaccgtacgggttaccgttaaccctttaaacgaaacttaccggaaaccctaaacgaacgtaccgggtaacccgtaggttacgggaaaaccaacgaaaccgtaacccaaacttaactttaaacttaccgtttagggtacgtaacccaaacgaaggaaacggttaacgggaacccgggggacaacgggtacccggttaggggtttacgggggtttacgggggtaccgttaaacgggttcgggggacccgtaaacgggggtaaccccgtcgggtaacccgtaaacccggttaccgttcccgacctaccgacccgttacccgaaaccccggg

SEQ ID NO: 330834 - DNA, 517 bp, Homo sapiens
  misc_feature: GZ8MTXP02I88YC.4.75.G09.1.454.CMB.2.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (405)..(405): a, c, t, g, unknown or other
  misc_feature (405)..(405): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgccaccctcagtgtccgtcgtccccaggacagacagccagcatcagctgctctgganataagtggggataagtatgttgtggtatcagnagagccaggccagtcccctgtgctggtcatctattatgataccaagccgccctagacgggactcccctgagcgtattccgctggcctaccgaactcgtacggggaaacacacgcccactctacgaaccatcgacggccgggacccagggctagnggatggagctgacttagttactgtcgagggcggtagggacagcacgcaacctcctatcgtcttcgacgtacgtacggaacgacggtcaccgtacgtacggccacgaaccccg

SEQ ID NO: 330835 - DNA, 616 bp, Homo sapiens
  misc_feature: GZ8MTXP02GXKQB.4.75.G09.1.454.CMB.2.raw
  modified_base (352)..(352): a, c, t, g, unknown or other
  misc_feature (352)..(352): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtggttctcactcagcacgtaggcggaggtgggtgtgggctggactccgtcacgccccgaggaacggccgtggagtgctgcactctattagtggatgatagatagcgactacacgcctagtctctagatagacgcgctacaccntaccaacgaacgaccaccaaacgaaacgtcggtacgtaccttacaacgtcaactaacacgtaccggactggacgacacgacgacccaaatacttaacgttacnggtacgacctaagacgacggaacgtaccgggngtaacggcgttacggggttacggggttcgggaccgtttacggggaccggggtaaccgtaaccgggtacccgttacggcccgttaccccgtcttacccgaccgtacccgccccgtaaccggaaccccggg

SEQ ID NO: 330836 - DNA, 571 bp, Homo sapiens
  misc_feature: GZ8MTXP02JGABQ.4.75.G09.1.454.CMB.2.raw
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgcacgccccaggaacgccctggagtggcttgcactcatttatgggatgatgataagcgctacagccatctctgatgacagctcacnctacaccaaagtccgacctaccaaaaacccgngtacgtacctttaacaaatcgaaaccaaacgatacggaacccctggacggacaaccgaacaccaaactactaagttacctgggtacacaacgacgagtaacaaccggggatacgacgtacggttgggttacgggacgtacgggtacgggaccgacggtaccgtcgtaaccgtaccgttcctccgtacgaccgtaccctaccgaccg

SEQ ID NO: 330837 - DNA, 515 bp, Homo sapiens
  misc_feature: GZ8MTXP02I7ITB.4.75.G09.1.454.CMB.2.raw
  modified_base (217)..(217): a, c, t, g, unknown or other
  misc_feature (217)..(217): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctgganataaagtggggataagtatgttgtgtatcagcagaagccaggccacgtcccctgtgctggtcatctattatgactaccaagccggccctagagggtacctcccgtagacgcgtattctactcggcctaccaactcgtagggaaccacgacgacccactcctagaaccatcgaacggccggaacccaggctagcgatgaggctgacttatacgtgtcgaggcgtaggacagcagccactctacgtgtcctcggactcggtacggaacaacggtccaccgtcgtacgaccgacgaccccg

SEQ ID NO: 330838 - DNA, 652 bp, Homo sapiens
  misc_feature: GZ8MTXP02F8O74.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggatccgtcagcccccaggaaaggccctggagtggcttgcactcatttagtggatggatgataagcgctacacgccatctctgatagaacaggctacaccataccaaccgaaacggaccgaccctaaccaaaaaccgtacggtacgtaccttaacgaatacgaaccaaacacgtacggtaaccctaggtacggaaaccaccgaacggacccaaactaactttaacttacgttacggttacgaccgaaaccgacggtaaggaacggttaccggggaccgtaacggaccggtacgggttagggggttttcgggggaccgttaccgggttacgggggacccgtaacggggtaaccccgtcggtaaccgtaacccggttcctacccgtcgaccggtcccctacgaaacccccggg

SEQ ID NO: 330839 - DNA, 645 bp, Homo sapiens
  misc_feature: GZ8MTXP02GKEAS.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccgaggaacggccgtggagtggcttgcactctatttagtgggatgatgataagcgacacacgcccagtctctgactgaacacggtctaccaccactaccaaaccgaaacggaccgaccctaaccgaaaaaccgtcgggtaccgttacccttaaacgaactaccgaaccaacgtagtaccggaccctaggacggacacgacgaccaatacttacttagttcgagaccaacgaggaaggtaacggttaccggggacaaacggtccgttaacggggtttcggggtttaacggggccggttaaacgggccgggggtaacccgaacggggtaacccgttcgggaacccgtacccgtccgtaccgtcccgaacgtccccgtaacccgaacccgg

SEQ ID NO: 330840 - DNA, 673 bp, Homo sapiens
  misc_feature: GZ8MTXP02F2NOQ.4.75.G09.1.454.CMB.2.raw
  modified_base (336)..(336): a, c, t, g, unknown or other
  misc_feature (336)..(336): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtggtgggctggatccgtcacgccccagggaaacggccgtggagtggcttgcactctatttagtgggatgatgataagcgctacagcccatctctgatagaanacggctacaccactaccaaccgaaacggaccgaccctaacccaaaaaccgacgggttacgtacccttaacaaacgtacgaaacccaaacgtagtaccgggtaccctagggtacggaaccaacgaacgtacccaaactaactttaacttacgttaggtaacgaccgaaaccgaggtaaacggaaacgttacggggacccaaggtaccggtaacggggtttacggggtttggggtaccgttaaaccggggttcgggggaacccgtaacggggtaaacccgttcggtaacccgtacccgtaccgttacccgtcgaccgtacccgtacccgaaaccccggg

SEQ ID NO: 330841 - DNA, 657 bp, Homo sapiens
  misc_feature: GZ8MTXP02GLQSE.4.75.G09.1.454.CMB.2.raw
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggaggtgggtggtgggcgtggatccgtcacgcccccgaagggaaacggcccgtggagtggtctgcacttcatttagttggatgatgatagcncacacgccatctntgatagaacagctacacntaccaacgaacggaccgacctaaccgaaaacgtagggtacttaccttaacaacgtacgaacctaagacgtacggaccctggtaacgactacacgaccataacttacttacgtcgtagaccaagaagaacggtaacgacggggacacggtaccggtaacggggtttcgggggttttacgggggaccggttaaacggggtccgggggtaacccggtaaaaccggggtaccccggtttacggggaaccccgtaccccggttaccgtacccgtaccgtacccggtaaccccgacccggtaaaacccccgggg

SEQ ID NO: 330842 - DNA, 561 bp, Homo sapiens
  misc_feature: GZ8MTXP02I3MD9.4.75.G09.1.454.CMB.2.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatcgtcacgccccaggaagcctgagtggcttgcatcntttatgggatgatgataagcgctacngccatctctgactgacaggctcaccntcaaccgagaccgcctaacaaaaccnggtcgaccttaanatacgaccaatataccgggacctggtacgacaactacgccaactatacttactggtnaccgaaggagaagtacgtcggacacgcgtacggttggggttacgggaccgtacggtcggggacccgtaacgggtacccgtcggtaaccgaccgttccgtacccgtacgtacccgtacccgtaccgaacccg

SEQ ID NO: 330843 - DNA, 710 bp, Homo sapiens
  misc_feature: GZ8MTXP02HTW16.4.75.G09.1.454.CMB.2.raw
  modified_base (367)..(367): a, c, t, g, unknown or other
  misc_feature (367)..(367): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcataggcggaggtgggtgtggggctggactccgtcacgcccccgaggaaacggccccgtggagtggcttgctactctatttagttggatagagtgaataagcgactaacacgccctatctctagagtacgaacgacggactacaaccnctaccaaccgaaacggacccgaaccctaacccgaaaaaaccgtacgggtacggttaacccttaaacctaaacgtaccggaaacccaaactaacggtaccggtaaacccgttaggaaccggaacaaaccgaacggacccccaaataactttaactttaacgtcgggtacaccgaaaccgaaggaacggtaaacgtaaccggggacacggacggttaacgggttcggggtttacgggggacttaccgggacgggggacccgtaaccggggtaaccccgtcgggtaacccgttaccccgggtccttacccccgtacgacccgtaccccgtacccgaaaccccgggg

SEQ ID NO: 330844 - DNA, 583 bp, Homo sapiens
  misc_feature: GZ8MTXP02I30LX.4.75.G09.1.454.CMB.2.raw
  modified_base (323)..(323): a, c, t, g, unknown or other
  misc_feature (323)..(323): n is a, c, g, or t
  modified_base (407)..(407): a, c, t, g, unknown or other
  misc_feature (407)..(407): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcagcactagcggagtgggtgtgggctggatccgtcacgccccaggaagcctggagtggcttgcactctatttgttggatgatgaatacgcactacagcccatctcngatagaacacgcctacaacctctaccaaccgaaagaccgacctaaccgaaaaccgtggtaccgtacttacaactacgaaccaanatccggaaccctgtacgacacacgacaacattacttactgtcgaccagaagagaacgtacggacacgcgttaacggtgggtttacgggacctacgggtaccgggggacccaacggggtacccttcggggaacctcccggtaccgtaccctcggaacctcccgtacccaaccccggg

SEQ ID NO: 330845 - DNA, 657 bp, Homo sapiens
  misc_feature: GZ8MTXP02IUASJ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccaggaaacggcccgtggagtggcttgcactctatttagttgggatgatgaataagcgctacagcccatctctgatagaacaggctaccaccactaccaaaccgaaacggaccgaccctaaccgaaaaacccgacggtacggtacccttaacaaactacgaaccaaacgacgttacggaacccttaggtacggaaccaacgacgacccaacaacttaatttaccgtgtacgaccaacgaaggaagaacgttaaccgggagtaacgccggtaacgggtttcggggtttacgggggtaccgttaaccgggtacgggggaacccggtaacggggtaaaccccgtcggggtaacccgtacccggtcctaccccgtcgaccgtccccgtacccgtaaaccccgg

SEQ ID NO: 330846 - DNA, 644 bp, Homo sapiens
  misc_feature: GZ8MTXP02FMFLS.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcagctgctcgtggagataaagtggggataagtatgtttgtgtatcagcagagccaggccagtccctgtgcgtggtcatctattatagactaccgagccgacctgaggaccctcccgtagacgcgtacttctcgtcggcctaccgtaaacgtccgtacggggaaacaccgacggtaccctacgttcctacggaaccctagtacccgaccggggacccggggaaacccgaggggtaccttaagggtacggtaagttcggggaacggtaccgtagtaaacccgtttagtttaacgtcggttaccgaggggtacggtacgggacacgcgaacgtccctaccttccgttaagttccggttccgttaccgggacctaccgggttaacgggaacccgtaaaccggttccgtacccggtaccgttacggaccacggtaaacccccg

SEQ ID NO: 330847 - DNA, 550 bp, Homo sapiens
  misc_feature: GZ8MTXP02GVML6.4.75.G09.1.454.CMB.2.raw
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (452)..(452): a, c, t, g, unknown or other
  misc_feature (452)..(452): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgcccccgaggaacggccctggagtggcttgcactctatttagtggatgatgaatagcgactacacgccatctctgatgaacngctcacntcacagaccacctaacaaacgngtcgtactaagactacgaccaanacgtcgaccctgacgaacacacgaccatacttatactgtacgacacgaggacaacggtaccgganacggacgtacgggtttggggttcgggcgttaacggcgggaccgaacgggtaccctcggtcctacccgtctaccgtacgaccgtaccctacgaacccgg

SEQ ID NO: 330848 - DNA, 707 bp, Homo sapiens
  misc_feature: GZ8MTXP02GW9J6.4.75.G09.1.454.CMB.2.raw
  modified_base (651)..(651): a, c, t, g, unknown or other
  misc_feature (651)..(651): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaaaccccacacacgaccctcacgctcgacctgccaccttctctcgggttctcactcagcactaggcggaggtgggtggtgggctggactcccgtcaccgcccccgaaggaaacggcccgtggagtggcttgcactctatttagtggatgatgaataagcgctacacgcctatctcgtagatacgaacgacgtcctaccaaccactaccgaaaccgaaacggtaaccccgaacccctaaacccgaaaaaaccgtacgggtacgttaaccctaaacgaaacgtacgaaaccctaaacgtacgtccggtaaccctagggtaccgaaaccacgaaaccgaccaaactaaacgttactttacgtagtacaacgaacgagaaacggtaacgaccgggagtacgaccgttacgggggttacggggtttacggggaccgtacggggtaccggggacccgtaaaccggggtaacccctccgggggtaacccncccggttaccctacccgtaccgacccggttacccccgaaccccgtaaacccccggg

SEQ ID NO: 330849 - DNA, 579 bp, Homo sapiens
  misc_feature: GZ8MTXP02IIN0I.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgcccccaggaaaggccctggagtggcttgcactctatttattggatgatgataagcgctacacgcccatctctgatgaacaggctcaccatccaaccaaacggaccgaccctaaccaaaaaccgagggttacgtaccctttaacaaactacgaacccaaactacgtcggaccccttggtacggaccacaacgcccaactacttattacgtgtacgacaacagagatagtgggcagccgtaggttgggtttcgggggacttacggtcgggggaccgacggggtaacccgtggtaccacccggtctcccgtacaccgccctaccccg

SEQ ID NO: 330850 - DNA, 669 bp, Homo sapiens
  misc_feature: GZ8MTXP02IWS4J.4.75.G09.1.454.CMB.2.raw
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (420)..(420): a, c, t, g, unknown or other
  misc_feature (420)..(420): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctcttgggttctcactcagcacgtaggcggaggtgggtgtggggctggactccgtacacgacccccgaaggaaacggccctgggagtcggacttgactacgtctatttagttggatagatgaataacgcgactacacgcctatctcngatagaacacgctacacnctaccaaaccgaacggaccaccctaaacaaaacgtcggttacgtaacctaanaaacgacgtaaccaaatacgtccgaaccgttgaacgaaccacgacgacctaaatactttaattacgtacggacgaccaagaaggaacggtaacggtaccggacgaacggtacgttaaccggggtttggggtttacggggacttaccggggtaaccgggggacccgaaaccgggggttaaccctcgggtaacccgtacccggttccttaccccgacgaccccgttaccccgacccggtaaaacccccggg

SEQ ID NO: 330851 - DNA, 806 bp, Homo sapiens
  misc_feature: GZ8MTXP02J29MG.4.75.G09.1.454.CMB.2.raw
tcagagcactgtagcacgaccggtgctcgatttagtatagacatcagggtcttcgtgactcctgtgccccaccatggacacactttgctccacgctcctgcctgctgaccatcccttcatgggtcttgtcccagatcaccttgaaggagtctggtcctacgctggtacgaaaccccacacacgacccctcacgctagacctgcctacctttctcgtgggttcctcactcagcagtagcggagtgggtgtgggctggactccgtccacgccccgaagggaaacgcccgtggagtggtcttgctactctatttagtggtatgatgatacgcgtactacacgccatctctagatacgaacgagcctaccacacgtaccaaaccgaacggacccgtaacccgtaaacccgtaaaaaacccgtcgggttaacccgttaaaccccttaaacgtaaacgttaaccggaaaccctaaaaccgaccggtttaccggaaacccccgtttagggtaacccgggtaaaaccaacccggtaaacccgaaacccctaaaccgtaaacgtttaaacctttaccccggtttagtaacccggtaacctaaaccggtaaagggaaaccgggttaaaccggtaaccggggaccgtaaaacgggtcccggtttaaacgggggtttcggggggtttaccggggaacccggttaaaccggggttcccgggggtaaaccgggaaccccgggtaacccggttaccggtaacccgtaacccggttacccttccccgacgtacccggaacccccgtacccgaacccccgggg

SEQ ID NO: 330852 - DNA, 640 bp, Homo sapiens
  misc_feature: GZ8MTXP02FK8P4.4.75.G09.1.454.CMB.2.raw
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (446)..(446): a, c, t, g, unknown or other
  misc_feature (446)..(446): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacaaacccacacacgaccctcacgctcgacctgcctaccttctcgtggttctcactcagcacgtaggcggtaggtgggtgtggggctaggtactccgtacaccgacccccgaagggaaacggccgnggagtggcttcgcactctagtttagttggatagatagaagtaacgcgactacacgtcccatccgtntagagtacgaacgaggtaccaccaccacgtaccaaacggaacggacccaaccctaaaccgaaaacgtcggtaacgttaccttaaacaanaaccgaacaacgacgtaccggacctgacgaacactaacaccaataatactactaggaacaccgaaacgagaacgaaggacccgagtacgaccggtagggtttcgggtacgggtaccgttacgggaccgggaccgaaaccgggtcccgtacgaaccgtaccgtactaccgaacgccggtacccaccgaaacccgg

SEQ ID NO: 330853 - DNA, 589 bp, Homo sapiens
  misc_feature: GZ8MTXP02G4YLV.4.75.G09.1.454.CMB.2.raw
  modified_base (503)..(503): a, c, t, g, unknown or other
  misc_feature (503)..(503): n is a, c, g, or t
tcagagcactgtagcacgaccggtgctcgatttagtatagacatcagggtcttcgtgactcctgtgccccaccatggacacactttgctccacgctcctgctgctgaccatcccttcatggctcttgtcccagatcaccttgaaggagtctggtcctacgctggtgaaacccacacagaccctcacgctgacctgcaccttctctgggttctcactcagcactagcggaggtgggtgtgggctggatccgtcacgcccccgaaggaacggcccgtggagtggcttcgcactctatttagtggatgatgatagcgactacacgcctatctcctgactagaacgcgcctacaccactaccaaccgaacgaccaccctaaaccgaaaacccgtaggttacgtacccttaagaactacgaacctaaactacgtacggacccttaggaccgacaaccgtacgaccctaatagttacttacgtgacgaccagaagagtacgtaacgggnaacggtcgtacgggtgggtttcgggacttacgggcggggaaccgacgggtacctggtacctaccgtctacgcaccgtcctaacccg

SEQ ID NO: 330854 - DNA, 631 bp, Homo sapiens
  misc_feature: GZ8MTXP02JSH9C.4.75.G09.1.454.CMB.2.raw
  modified_base (351)..(351): a, c, t, g, unknown or other
  misc_feature (351)..(351): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctgggttctcactcagcactagcgggagtgggtgtgggctggactccgtcacgcccccaggaacggccctggagtggctgcactctatttagtggatgatgaatagcgctacacgccctatctctgatacgacacggctaccacnctaccaaccgaaacgggacctaaccctaaaccgtaaaaaccgtggggttaccgtacccttaaactaaacgtaccgaaacctaaacgacgtaccgggaacccccttgggaccgaaacgaaccgtaaccggaccctaaactaagttacttactcggtacgacaacgagagtacggacggggacaggcgtacggttggggtttcggacgtacgggtcggggaccgaacggggtaccctcggtaaccgacccgttcctaccgtacaccgtccacccgaacccgg

SEQ ID NO: 330855 - DNA, 569 bp, Homo sapiens
  misc_feature: GZ8MTXP02HPC1W.4.75.G09.1.454.CMB.2.raw
  modified_base (314)..(314): a, c, t, g, unknown or other
  misc_feature (314)..(314): n is a, c, g, or t
  modified_base (461)..(461): a, c, t, g, unknown or other
  misc_feature (461)..(461): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcctaccttctctggttctcactcagcactagcggagtgggtgtgggctggatccgtcacgcccccaggaaacggccctggagtggcttgcactcatttatggatgatgatagcgctacncgcccatctctgatagaacaggtctacaccactaccaacgaaacggacccgaccctaacccgaaaaaccgtgggtaccgtaccttaacaataccgaaccaaacgtacgtacggaccttggacggacacgacgaccaacattattacngtcgacacgagagagacggcagctacggtgggttggctacggtcggggaccgacggtaaccgtcggtccgaccgtacctcccgactaccggaccttacccgaacccgg

SEQ ID NO: 330856 - DNA, 661 bp, Homo sapiens
  misc_feature: GZ8MTXP02HEMZR.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaaccccacacacgaccctcacgctgacctgcctaccttctcgtgggttctcactcagcaactaggcgggtaggtggggtggtggggctggactccgtcaccgacccccgaagggaaacggcccgtggagtggcttgcactctatttagtggatgatagaataagcgactaacacgaccctatcctctagatacgaacgacggcctaccaaccactaccaaacccgaacggacccaccctaaacccgaaaaaccgtggtaccgttaacccttaagaactacgaaacccaactacgccggaacccgttgacggacacaacgaccaataattactaatcggtacacaacgaagtaggaacgacggacaggaccgtacggggttagggtttcgggacgtcgggtaccgggggaccgaaaccggggtaacccgtcggttccccgaaccggtttcccgacccgtacgtaccccgttcccctaccggaaaacccccggg

SEQ ID NO: 330857 - DNA, 848 bp, Homo sapiens
  misc_feature: GZ8MTXP02IHDHO.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctgggttctcactcagcactaggcggaggtgggtggtgggctggacgtccgtcgacgcccccgaagggaaacggtccccgtgggtacggtcggtaccgtttacggacctaacgtttaccgttaagttttaaacgttttgggggaattaggtaagttaggtaaaacgtttaaaacgggcccgggtaacctttaaacccgaaccggtaccccccgtaaagtttcccttaccgttaccggtaaacgttaaccggaaaccgtacggggtccttaacccaaacccgtaccttaaccgtaaaaccccggaaaaccgggaacccccgtaaacccccgtaaacccgtaaaaaaacccgtacgggggttaaccgttaaccctaaaccggtaaactacgaaacccaaaacgtacgtaccggtaacccgttaggtaccgggtaaaccaaccgtaaaccggaccctaaaccgttaactttaaacgttacgttacgggtacaccgaaaccgaaggtaaacggtacggtaaaccgggcgtaacgtaccggtaggggtttcgggttacggggacgtaacgggttcggggacccgaaacgggtacccgtcgggtaacctaccggtccttacgaccgtaccgaccctaaccgaaccccgg

SEQ ID NO: 330858 - DNA, 698 bp, Homo sapiens
  misc_feature: GZ8MTXP02IJRD3.4.75.G09.1.454.CMB.2.raw
  modified_base (203)..(203): a, c, t, g, unknown or other
  misc_feature (203)..(203): n is a, c, g, or t
  modified_base (349)..(349): a, c, t, g, unknown or other
  misc_feature (349)..(349): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcacctttgaaggagtctggtcctacgctggtgaacccacacagaccctcacgctgacctgcaccttcnctggttctcactcagcactagcggagtgggtgtgggctggatccgtcacgccccaggaaagccctggacgtggcttgcacgtcatttagtgggatgatgataagcgctacagcccatctctcgatacgaacgacggactccaaccnctaccaaaccgaaacggaccgacccctaaccgaaaaaaccctacgggtacgttacccttaaacgaaactacggaaaccctaaagaacgttaccgggaacccccttagggtaaccgggaaacctaaccgaaaccggacccctaaacgtaaactttaaacgtttaccgttacggttacgaacccgaaccgtaaaggaacggtaacgtaaaccggggaccaaaggtaccgtaccgggtaggggtttttacggggaccgttaacggtacgggggacccgtaaacggggtaacccgtagggtaacccgaaccccggttctaccccgtacgaccggacccctaccgaaaccccgg

SEQ ID NO: 330859 - DNA, 660 bp, Homo sapiens
  misc_feature: GZ8MTXP02JGE21.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcacgtagcggagtgggtgtgggctggactccgtcacgaccccgaagaacggccgtggagtggacttgctactctatttagtggatgatgaataagcgactacgacgccatctactcgatacgaacacggctaccactacgaccaaaccgaacggacccgaccctaaacccgaaaaaccgtacggttaccgttaaccttaaacaaacgtacggaaacccaacgtacgtccgggtaaccgttggtaacggaaaccacgacgaccctaaactacttacttacggtacgtcgactaacggagaaacggtagtacccggggatacggacgtacggggttacgggttcgggaacgtcggtaacggggtccgggaacccgggtacggtacccggttaacgacccgttaccgttccgacccgttccgacccgttaccgtaaacccccg

SEQ ID NO: 330860 - DNA, 652 bp, Homo sapiens
  misc_feature: GZ8MTXP02IKNAW.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcctaccttctcttggttcctcactcagcactagcggagtgggtgtgggctggactccgtcacgccccgaggaaacgccgtggagtgctgcactctattagtggatagtatgaactaacgcgtactaacacgtcccctatactctagactacgaacgtacggcctaccaacctacgtaccaaaccgtaaacgggacccaaccctaaacgaaaaccgttaggtacgttacctaacgaactacgaaaccaaatacgtaccggtaaccctaggtacgaaacacgacgaccctaaatactttacgttacgtaggtacacgaacgaaggtacgaacggtacgggacacggacgttacggggttgggtttaccgggacgttacgggcggggtaccgtaccggtaacccgtcggtaaccgtacccgtcttaccgaccgtacgtacccgtaaccgaaacccggg

SEQ ID NO: 330861 - DNA, 753 bp, Homo sapiens
  misc_feature: GZ8MTXP02FTKMQ.4.75.G09.1.454.CMB.2.raw
  modified_base (174)..(174): a, c, t, g, unknown or other
  misc_feature (174)..(174): n is a, c, g, or t
  modified_base (202)..(202): a, c, t, g, unknown or other
  misc_feature (202)..(202): n is a, c, g, or t
  modified_base (550)..(550): a, c, t, g, unknown or other
  misc_feature (550)..(550): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttntctgggttctcactcagcactagcggagtgggtgtggggctggatccgtcaccgacccccgaaggaacggccgtggaggtggtcttcgctactacttatttagtagggtatagtatagaataacgccgactaacgaccgacccattccttcgtacgtagtacgaaacgacggtcctacccaactacacccaaaccgaaacgggacccaccctaaaacccgaaaaaccgtaggggttacccgttaaccctttaaacaaacgtacaaacccaaacgtacgaccgggtaacccttagggacgaaaccaaccggaccgaacccctaaataagtttaacttaccgttaggganaacccaacgaaggttaacgtacggaaccggggactacggacccggtaacgggggttttgggggtttacgggggaaccttaccgggggtaccgggggaacccgggtaaaacccgggggaaccccgtttcggggaacccccgtaaccccgggttaccccttccctacgtaacccggtaccccctaaccccggaaaaccccggggg

SEQ ID NO: 330862 - DNA, 902 bp, Homo sapiens
  misc_feature: GZ8MTXP02HW3HL.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctctgggttctcactcagcactaggcggtaggtgggtgtggggctggactccgtcaccgccccgaaggaacggcccgtggaggtgctgctactctagtttaggttggtaatgtagtaagtagtaacggccgtacgtaacgaccggtacccctaattccgttacgtacgtacgtaacggaacgtacgggtacccttaaccgaacccctaacgtacccgaaaaccgtaaacccggggaacccccgttaaacccccgtaaaaccccgtaaaaaaccgggtacccggggtttaaccgttaaccccttaaaaacgtaacgttaacccgaaaccctaaacgtacgtacccggtaacccgttagggaacccgacccgaacgaaaccgaccctaaacgttaacttttaaaccgttaacgtacggtaaccgaacccgaaaggttaacgaaaacggggtccggttaaaacccggggacgtaaaacggggttaccgggtttaacccggggtttaggggggggttttttcccgggaaaacccgggttaccgggggttaaccggggggtaaacccccggggttaaaacccggggttaacccccgggttcggtaaaacccccggtttcccccggttaaccctttaccccccgggggacctaaccccccgggtaacccccgtttaaaaccccggaaaacccccccggggg

SEQ ID NO: 330863 - DNA, 586 bp, Homo sapiens
  misc_feature: GZ8MTXP02HFQ52.4.75.G09.1.454.CMB.2.raw
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (368)..(368): a, c, t, g, unknown or other
  misc_feature (368)..(368): n is a, c, g, or t
  modified_base (446)..(446): a, c, t, g, unknown or other
  misc_feature (446)..(446): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaacgccctggagtgcttgcactcatttatggatgatgataagcgactacagcccatctcngatgaacagctcacnctacacaacggaccgacctaaccaaaacgnggtacgtaccttaacaatcgaaccaacgacgtacggacccttgacggaccacacgacccaacattaacttactaggtnacgacagacgatacgggacaagccgtaacgggtgggtttcggggcctaacgggtcggggacccgaacggggtaaccccttcgggtaacccgtacccggtccttcccgtacgtaccggtacccctacccggaaacccccgg

SEQ ID NO: 330864 - DNA, 683 bp, Homo sapiens
  misc_feature: GZ8MTXP02HUVCK.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgggttctcactcagcacgtagcggagtgggtgtgggctggactccgtcacgcccccgaaggaaaggcccgtggagtggcgttcgcactgtatttacgttgggatgatagtagtaagcgctacgacgcctactctcgtagtatacgaacgacgtactaccacctactaccaaacgaaacggacccgtaaccctaaacccgaaaaaccgtacggttaaccgttacctaaacaacgttacgaaacctaaacgtacgtaccgggtacctaggtacgaacaccgaacgacctaacgtaagttaacttactcgggtacacagaaacgtagaacggtacggacgacggtacgtacggggttgggttacggggtaccgtacggggtaccgggtaccgtaaaaccgggggtaccctacggggtaaccctaaccccgggtttcctaccgttaccggtacccggcccgtaaccccgtaaacccggggg

SEQ ID NO: 330865 - DNA, 589 bp, Homo sapiens
  misc_feature: GZ8MTXP02HZL7T.4.75.G09.1.454.CMB.2.raw
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcagctgctctggagtataaagttgggggataagtatgtttgttggtatnagnagaagccaggccacgtcccctgtgcctggcatctattntgataccaagccgccctacgaggacctcccgtgagtccgtattcctacgtcgggccttacccaaaccgttcgtacgggggaaccaacgtacgacccgtacnccttacgaccgactacgacggccgggaacccagggtccgtaagnggacttgggacggtcgtacgtacttacttagtcggttcgaggggtacgtcggggacacgcgacacctacgttaccctagttaccgtcgtcggctacggacggtaaccgaacggtcctacccggttacgtacggtaccgacgaacccccgg

SEQ ID NO: 330866 - DNA, 620 bp, Homo sapiens
  misc_feature: GZ8MTXP02G4NM2.4.75.G09.1.454.CMB.2.raw
  modified_base (513)..(513): a, c, t, g, unknown or other
  misc_feature (513)..(513): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgacccctcacgctgacctgcctaccttctcgtgggttctcactcagcactaggcggtaggtgggtggtgggcgtggactccgtcgacgacccccgaggaacgcccgtaggagtggcttcgctactctatttagttgggatgtatagtagtagcgactacacgcctatctcagatacgaacacgacctaccaccactaccaacgaaacggtacccaccctaaacccgaaaacgtacgggttacgtaccctaaacgtaactacgaaccaacgtagtccggacctgacgacacgacaccatactatacttgacacaacaggaagaacggtccgganacgtacgtacgggttggggttcggcggtacgggtacgggaccgaacgggtaccgtcggtccgtacccggtaccttccgaccgtacccgtcccgtaaccgaacccggg

SEQ ID NO: 330867 - DNA, 615 bp, Homo sapiens
  misc_feature: GZ8MTXP02FLKDH.4.75.G09.1.454.CMB.2.raw
  modified_base (216)..(216): a, c, t, g, unknown or other
  misc_feature (216)..(216): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgccaccttctcgtggttcncactcagcacgtaggcgggagtgggtggtgggctggactccgtcgaccgacccccgtaagggaaacggccgtggaggtggcttcgctactctatttgtggatgatganagcgctacncgccatctctacgagtacgaacacggctcaccactaccaacgaacgacccaaccctaaaccaaaaccgtcgggttacgtaccttaacgaactacgaaccaacgtacgtaccggaccgtacggtacgacacgacgacccaatagttaacttacgtagtacacgacgaggaagtacgacggacgacgaccggtaggttggggtcgggtacgtaccgggtcgggaccggaaccggtacccgtacggtccgtaccgtcctaccgacgaccggtaccaccgacccgg

SEQ ID NO: 330868 - DNA, 698 bp, Homo sapiens
  misc_feature: GZ8MTXP02HS4WE.4.75.G09.1.454.CMB.2.raw
  modified_base (297)..(297): a, c, t, g, unknown or other
  misc_feature (297)..(297): n is a, c, g, or t
  modified_base (433)..(433): a, c, t, g, unknown or other
  misc_feature (433)..(433): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactaggcggaggtgggtggtggggctggactccgtcacgcccccgaaggaaacggcccgtggagtggcttgctactntatttagttgggatgagtagaagtaagacgtctacacgcctatctctagagtacgaacgcggactccaaccactaaccgaaaccgaacgacccgaaccctaaacccgaaaaacgtacggggttactaaccttaaanaactacgaaacccaagtacgtaccggaccgttaggacggaccaaccgaacgccctaaactaactttaacgtacgttacggacacgaaacgaacggaaagtacggtaccgggacgtaacgtaccgggtacgggtttacgggggttacgggtaccgttacggggtaccgggggaacccggtacccgggggttaaccccgttcggtaacccgtaaccccggttcctaccccgttcgaccccgtacccccgtaaccgaaacccccgggg

SEQ ID NO: 330869 - DNA, 667 bp, Homo sapiens
  misc_feature: GZ8MTXP02FNY1W.4.75.G09.1.454.CMB.2.raw
tcagagcactgtagcacgaccggtgctcgatttagtatagacatcaggggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgctaccttctcgtggttctcactcagcacgtaggcggagtgggtgtgggctggactccgtcacgcccccgaggaacgcccgtgggacgtggctgacactctatttagtgggatgatgataacgcactacacgccatctctagatagaacacggcctaccaaccacgtacccaaaccgaaacggacccgtacccctaaaccgaaaaaccgtgggttaccgtaccttaaacgaacgtacgaaccaaacgtacaccgggaccttggacgaaccaacgacaccaatatactactgtacgaccagacgaaggacgtcgggacgacggaccgtaggggttacggggttaggggtccgtaaacggggtccgggggaccggtaaacccggggtaaccccggttacgggtaacccccgtacccggttccccgtaccttacccggacccgtacccccgttacccggaaaacccccggg

SEQ ID NO: 330870 - DNA, 625 bp, Homo sapiens
  misc_feature: GZ8MTXP02HJOXJ.4.75.G09.1.454.CMB.2.raw
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
  modified_base (604)..(604): a, c, t, g, unknown or other
  misc_feature (604)..(604): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgtgggttctcactcagcacgtaggcgggtaggtgggtggtgggcgtggactccgtcaccggacccccgaagggaaacggcccgtaggacggtggcttgccgactctagtttagtgggatgatagatagcgtactacncgccatctntacgagtagaacgacgtctaccacnctaccgaaccgtaacggacccaccctaaacccgaaaacgacgggttacgtaccttaacaacgtacgaaccaacgagtaccgaccgtggacgacacgacacctaatattaacttactgtacacacgagacacggtacgacgacgacggtcgggttagggtcggacgttaccgggcggggacccgtacgggaacccgttcgggaaccctacccggtctccgtaccncccgaccgtacccgaacccgg

SEQ ID NO: 330871 - DNA, 571 bp, Homo sapiens
  misc_feature: GZ8MTXP02GG9JU.4.75.G09.1.454.CMB.2.raw
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
  modified_base (554)..(554): a, c, t, g, unknown or other
  misc_feature (554)..(554): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtggggctggatccgtcacgccccaggaacggcctggagtggcttgcactctatttatggatgatgataaggcgctacgacgccctatctcgtgatgaaacaggctaccaaccatccaaccgaaaggaccgaccctaaccaaaaaccgngggtacgtcttaaacgatagaccaaatacgtcgacctgtacgacanacgccatatatacngtanacaganagaagtacggnaacgctaggttcgggttagggggacttacggtacggggccgaaacggggacccccttagggtcctaaaccccggtcttcccggaacccnccgacccgacccgaccg

SEQ ID NO: 330872 - DNA, 704 bp, Homo sapiens
  misc_feature: GZ8MTXP02HDCT2.4.75.G09.1.454.CMB.2.raw
  modified_base (298)..(298): a, c, t, g, unknown or other
  misc_feature (298)..(298): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtggttctcactcagcacgtaggcggtaggtgggtggtgggcgtggactccgcgaccgccccgaaggaacgccgtggagtgcttgcactntagtttgtggatgatagaagtagcgtactacgcgacctatcctctagactacgaacgacgtcctacgaaccacgtaaccgaaaccgaacggaccctacccgtaaaaccgaaaacgtacgggttaccgtaacctaaacgaactaccggaaacctaaacgacgtacccggtaccgtcggtaacggaaccacgaacgaccctaaactactttacgttaccgtaggtaccgaacgtaacgaaggtaaccggtaaacggtaccgggacgacgttacgggtttaacggggtttcgggggtttacggggtaccgttaacgggggtccggggaaccgtaaccggggttaacccgtcgggtaacccgtacccgttcgtacccgttacgacccgtcccccgaccgtaaaccccggg

SEQ ID NO: 330873 - DNA, 721 bp, Homo sapiens
  misc_feature: GZ8MTXP02HLOX7.4.75.G09.1.454.CMB.2.raw
  modified_base (222)..(222): a, c, t, g, unknown or other
  misc_feature (222)..(222): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctggttctcactcanacacgtagcggaggtgggtggtgggctggactccgtcaccgccccaaggaaacgccgtggagtggcttgcactctatttagttggatgatagaataacggcgtactacacgacccattccgtcttagactagaacacggtactacaccgtataccgaaaccgaaacggacccgtaacccctaaaccgaaaaaccgtacgggtacgtaaccctaaataaacgacgaaaccctaacgacgtccggacccttaggacgaaccacgaacgtacctaacgacttttagtacctaggtaacnccgaanaaacggtgtaaaccggttagggaccaacggtacccggttaagggtttgggggtttccgggtaccgtttaaaccggggcgggggtaaaccccggttaaaacccggggtcccgtttacgggaaacccccgttcccgggtttaaccttaacccccggctttaacccggccccccgtttaaaccgaaaaaccccccggggg

SEQ ID NO: 330874 - DNA, 705 bp, Homo sapiens
  misc_feature: GZ8MTXP02H89D4.4.75.G09.1.454.CMB.2.raw
  modified_base (387)..(387): a, c, t, g, unknown or other
  misc_feature (387)..(387): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggttctcactcagcacgtaggcggtaggtgggtggtgggctggactccgtcaccggaccccgaggaaacggcccgtaggagtcggtctcgcacgttactagtttagttgggagtagtatagtaagtaacgcgtctacacgccctacgtactcgagactacgaacgacggcctaccaacncgtaccgaaccgaaacggaccgtaaccctaaacccgtaaaacggtacgggttaccgttaccctaacgaaactaccgaaacctaaacgtacgtacggtaccgtcgtacggaccacgaccgacctaacaatttacttacgtaggacaaccgtagaacggacgtaacggtcgggaacgtaccgtaccggttacggggttcgggggtttacgggtaccgttaaccgggggccggggtaacccgaacgggttccccgtacgggtaacccgtacccggtaccttccccgtaacggaccccgtaccgtaccccgtaaaccccggg

SEQ ID NO: 330875 - DNA, 791 bp, Homo sapiens
  misc_feature: GZ8MTXP02FY5KQ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctgggttctcactcagcactaggcggaggtggggtggtgggcgtggactccgtcaccggaccccgagggaaacggcccgtagggaggtcggtcttcggactacgtactttagttttaggttaggggtattggtagttaggaagttaacggccgtaccttaccgaccggtacccctaacttcctccgttagaacgttacgaaacgtaccggtacctacccaaccctactaccgaaacccggtaaacggaacccccgtacccctaaaaccgaaaaaccgggttacgggtacccggttaaccctttaaacgaaacgtaccgaaacccaaacgtacggtaccgggtaaccgtggtaaccgaacaccaaccggaaccctaactaaacgtttacttccttacgggacgacccgaaagaacggttacggaacggtacggggacaacggttacccggagggggttttcggggtttacggggacccgttaccgggggtacgggggtacccggaacccgggttaccggttaccgtaacccggtaccccgtaccgttccgaaacccgccggtaacccctacccggaaaaccccgggg

SEQ ID NO: 330876 - DNA, 619 bp, Homo sapiens
  misc_feature: GZ8MTXP02GPNOV.4.75.G09.1.454.CMB.2.raw
  modified_base (239)..(239): a, c, t, g, unknown or other
  misc_feature (239)..(239): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (456)..(456): a, c, t, g, unknown or other
  misc_feature (456)..(456): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacacgaccctcacgctgacctgctaccttctctggtctcactcagcacgtagcggagtgggtgngggctggactccgtcaccgcccccgaaggaacggcccgtggagtggtcttgctactntagtttagtggatgatagataacgcgtactacacgcctatccgtatgagtacgaacgngtcctacaacccacaaccgaaccgaacggaccctacccaaaccgtaaaaccgtggttacccgttacttaaacaaataccgaaccaacgtagtccggtaaccncggtagaaccacgtacgacccaaataccttaagggttactacgtgacccaagggacctaaggaccgtagggccaggtcgtacgggttagggttcgggacttacgggcgggacctaaccgggtcacggtccacccgtccactcgaccgtccccgacgaacccgg

SEQ ID NO: 330877 - DNA, 690 bp, Homo sapiens
  misc_feature: GZ8MTXP02G4XPN.4.75.G09.1.454.CMB.2.raw
  modified_base (290)..(290): a, c, t, g, unknown or other
  misc_feature (290)..(290): n is a, c, g, or t
  modified_base (664)..(664): a, c, t, g, unknown or other
  misc_feature (664)..(664): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggttctcacctcagcacgtaggcggtaggtgggtggtgggcgtggacgtccgtacgaccgccccgaagggaacgccgnggcgtggcgtgcactctagtttagtggatagtatagaacgtacgcgtacctacacgacctctctagtacgagtacgaacgacgtcctaccaacctactaccgaaaccgtaaaccggaacccgtaaccccgtaaaccgtaaaaaccggtacgggttacccgttaaacctaaaccgttaaacgaccgaaaaccctaacgtaacgtacccggtacgttacgggacgaacctacgtaaccgacctaaaccttattaccgttagtcgtacgaaccgacggaagtaacggtaacggacgacgactcgggtacgggttcgggtagggtacggtcggtcgggacccgtacgggtaccgttcggtccgtacccgtcccgtacncccgtaccgacccgtaccgaacccgg

SEQ ID NO: 330878 - DNA, 658 bp, Homo sapiens
  misc_feature: GZ8MTXP02GO2D9.4.75.G09.1.454.CMB.2.raw
  modified_base (425)..(425): a, c, t, g, unknown or other
  misc_feature (425)..(425): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaacccacacacgaccctcacgctgacctgcaccttctctgggttctcactcagcacgtaggcggaggtgggtggtggggctggactccgtcgacgcccccgaaggaaacggcccgtgggagtggcttgcactctatttagtggatgatagagtaagcgactacacgccatctctgatagaacacggcctaccacactaccaacccgaaacggacccgtaccctaaccgaaaaaccgtcggttaccgtacccttaaanaacgtacgaaccaacacgtaccggacctaggtacgaccacgacgacctaactaacttactaacgtcgtacgaccacgaagacgaacggtacggggactacggccggtaagggtttcggggtttcgggggtacgttaccggggtacgggggtacccggaacgggtaccccgtacgggtcccgtaacccggttccctacccgtaccgacccgtccccgtaccccgtaacccgggg

SEQ ID NO: 330879 - DNA, 680 bp, Homo sapiens
  misc_feature: GZ8MTXP02GEQBT.4.75.G09.1.454.CMB.2.raw
  modified_base (454)..(454): a, c, t, g, unknown or other
  misc_feature (454)..(454): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgccaccttctcgtggttctcactcagcactaggcggaggtgggtggtgggctggactccgtacaccgacccccgaaggaaacggcccgtaggagtcgcttgctactctatttagtgggatgatagaataacgcgactaccacgaccccatcctacgtagaagtacgaaacgtacggcctaccaacctacaccaaaccgaaacggaccaaccctaaaccgaaaacgtggtaccgtaccttaacgaactacgaaccaanagtccgaccgtgtacgaacacaacgaccaatattacgtaacgtgtacaccgagtaacggagtaacggtaacggacgtacgtacggtaaacgggtttcgggttaccggggtacgttaccggggtacgggggtaaccccgtaaaccgggtaccccgttcgggtaacccgtacccggttcccgtacccgtaccggtaacccgcccccgttaaccggtaaacccccgggg

SEQ ID NO: 330880 - DNA, 686 bp, Homo sapiens
  misc_feature: GZ8MTXP02ID6UE.4.75.G09.1.454.CMB.2.raw
  modified_base (349)..(349): a, c, t, g, unknown or other
  misc_feature (349)..(349): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctcgacctgcaccttctcttgggttctcactcagcacgtaggcgggaggtggggttggtggggcgtgggacgtcccgtcaccggacccccgagggaaacggcccgtggagtggctgcactctattagttggatgatagataagcgactacacgccatctcngtatacgaacagacctccaccacaccaaccgaaacggacccgaccctaaaccgaaaaaccggtacggttaccggttaacccttaaacgtaaacgtaaccgaaacccgtaaacgtacgtaccgggaacccgttacgggtaacggaaccaaccgacgaacccctaaataacttaaacttacgttcggtacgaaccaacgtaagacggtaacgaccggggtacacggtacgttacgggttggggttcggggacggttacgggtacggggaccgtaaccggggtaacccgttcggaacccgtccgttaccctcccgacgaccgtcccgacccgtaaaccgg

SEQ ID NO: 330881 - DNA, 596 bp, Homo sapiens
  misc_feature: GZ8MTXP02FSWMD.4.75.G09.1.454.CMB.2.raw
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (452)..(452): a, c, t, g, unknown or other
  misc_feature (452)..(452): n is a, c, g, or t
  modified_base (525)..(525): a, c, t, g, unknown or other
  misc_feature (525)..(525): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctgggtcctacgctaggtgaaacccacacagaccctcacgctgacctgccaccttctctggttctcactcagcactagcggagtgggtgtgggctgatccgtcagcccccaggaaacgcctggagtaggcttgcatctattagtggatgatgataagcgactactacgcccatactctggactagaacgaggacctacaacctanccaaacgaacgtacccgaccctaaccaaaaccgngggttacgtaccttaacgaatacaaccaaacgactcggaaccctgacggaccagaacgccaaanattacttacgttgacgacacgagacgacgtacgggacagtccgtaacggttggtttacggggcttaaccgggnggggacccgtaacgggtaacccgtggaacccgtaccggtcttcccgacacgtaccccgtacgaaaccccgg

SEQ ID NO: 330882 - DNA, 666 bp, Homo sapiens
  misc_feature: GZ8MTXP02GFLSC.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactagcggagtgggtgtgggctggactccgtcacgcccccaggaaacggcccgtggagtggctgctactctatttagtggatgatgataagcgctacacgccatctctgatagaacacggctaccaaccactaccgaaaccgtaaacgggaccccgaacccgtaaacccaaaaaacccgtaggggttaccggttaaccctttaaacaaagttacgaaacccaaacgtacgtacggtaacccttcggtacgacaacgacgaccctaacgtaataacgtttactggtacgacgaaccgaaggtaagacgtacgggacgtacggcggtaacgggtttgggggtttacggggacgttaccgggtacgggggtacccgaaacggggtaaccccttgggaacccgtacccggttacctcccgtacgtaaccggtccccttaccgaaaccccgg

SEQ ID NO: 330883 - DNA, 556 bp, Homo sapiens
  misc_feature: GZ8MTXP02H8N1V.4.75.G09.1.454.CMB.2.raw
  modified_base (269)..(269): a, c, t, g, unknown or other
  misc_feature (269)..(269): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccacctcagtgtccgtgtccccgaggacagacagccagcatcagctgctctggagataaagtggggattaagtatgtttgtgtatcagcagagcaggccagtccccngtgctggtcatctattatgactaccaagccgcctacgagggacctcccgtagacgcgtatttccgtctcggccttaccgaaaccttcgaacgggaaaccacacgaccctaactccgagaaccccatcccgaagggacccgggaccctaagggctagtgatacgaggctagactatttacgngacgaggcggtagganacgacacgtacctacctcctagtcgttccgtcggcctacggtacgggaaccgtacggacctacccggtacgtacggaccaaccggacccg

SEQ ID NO: 330884 - DNA, 711 bp, Homo sapiens
  misc_feature: GZ8MTXP02IHYVF.4.75.G09.1.454.CMB.2.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtcgaaaccccacacacgaccctcacgctgacctgccaccttctctgggttctcactcagcactaggcggaggtgggtggtggggcgtggactccgcacgccccaagggaaacggcccnggagtggcttgcactctattagtggatgatagatacgcgctacncgccatctctagatagaacagctacaccataccgaacgaacgaccgaccctaaaccgaaaaccgtacggtacgtacccttaaacaacgtacgaacctaaacgacgtaccggtaacccgtacggtaacgggaaccaccgacgaaccctaaactaactttaacgttacccgttaggtacgaaccctaacgaaagtaaacccggaaggtaccgggacgtaacgggtaccgttaaccgggggtttgggggtttaaccgggggtaccggttaaccggggttaccgggggtaacccccgaaacgggggttaacccccgtttaccgggaacccgtacccggttaccgttccccgaccgtaccggacccccgttacccgaaaacccccggggg

SEQ ID NO: 330885 - DNA, 764 bp, Homo sapiens
  misc_feature: GZ8MTXP02HHA2A.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtggttctcactcagcacgtagcggtaggtgggtggtgggctggactccgtcgacgaccccgaggaaacggcccgtggagtggtacttgacacttctatttagtggatgaatgtagtaacgcgactacgaccgtccctactctcgtagactacgaacgacggtcctaccacacgtaccgaaaccgaaacggtacccgaacctaaaccgaaaaaccgtacggggtacgttacccttaaacaacgtaacgaaaaccctaaacgtaccgtaccgggtaacccttacgggacggtaaacccaaccgaaccggtaacccctaaacgtaaactttaacgtttaaccgttacggtaccgaaacgtaaaccggaaacggaaacggtaacggttaacccgggagtaacggggtaccgtttaacgggggtttcggggtttaaacggggtccggttaaaccggggtcgggggtaccccgtaaaccgggggttaaccccgcgggttaaccccgtaacccgttcccggtaccctaccgaccgtacccccgtaaccgtaaacccccgggg

SEQ ID NO: 330886 - DNA, 660 bp, Homo sapiens
  misc_feature: GZ8MTXP02JT3X0.4.75.G09.1.454.CMB.2.raw
  modified_base (295)..(295): a, c, t, g, unknown or other
  misc_feature (295)..(295): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcctaccttctcgtggttctcactcagcacgtaggcggaggtgggtggtgggctggactccgtcacggccccgaggaacggcctggagtggcttgcactntatttagtggatgatgagtagcactacacgccctatctctagatacgaacacggctaccacactaccaaccggaaaccggacccgaaccctaaacccgaaaaaccgtcgggttacccgttacccttaaacgaactacggaaaccctaaagacgttaccgggtacccctgggtacgaaccacgaaccgaccaaactacttaacttacgtggtacaccaagagaacgacgtacgggactacggcgttacggggttcggggttcggggaccgttaccgggtacgggggacccgtaaacggggtccccgtacgggttccgaaccccgttcgtacccgtacgaccccgtcccgtacccgaaaccccgggg

SEQ ID NO: 330887 - DNA, 762 bp, Homo sapiens
  misc_feature: GZ8MTXP02G6IF6.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggttctcactcagcacgtaggcggtaggtgggtggtgggcgtggactccgtcgaccgaccccgaagggaacggccgtgggagtggtctgcactctatttagtggatgatagatacgcgtactacgcgacctacgtctcgtacgtagtacgaacgacggtacctaaccgaacctactacccgaaacccgtaaaccggacccgtaaacccgtaaaacccgtaaaaaccggtacgggttacccgttaacccttaaacgaacgtacgtaaaacccaacgtaacggtaccggtacccgttagaccggaacaccgaaccacctaacttaattaccgttacgtacgtacgaacgacgtaaacgaacggtaacggtaccggacggtaaacgtccgggtttaaacgggttcggggtttacgggggtaaccgttaccgggggtaccggggtaacccggtaacccggggttaccccggttacggtaacccccggtttacccgttacccgtaccccgtaccggtaccccgttaaccccggtacccggtaaaaccccccgggg

SEQ ID NO: 330888 - DNA, 766 bp, Homo sapiens
  misc_feature: GZ8MTXP02HD8GQ.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctcgacctgcaccttctctggttctcactcagcacgtaggcggtaggtgggtggtgggctggactccgtcacgccccaaggaacggcctggagtgctgcactctatttagtggatgatagataagcgactacgacgcctatctacagatagaacgacgctaccaacctactaccgaaaccgaaacggaaccctaacccgtaaaacccgaaaaaccgggtcgggttaaccggttaacccttaaacgaaacgtacccggaaaacctaaacgtacgttacccgggaacccgttacgggaaccgaaaccgtacgtaaacccggaccctaaacggtaactttaaccgtttacgtacggttaacgaacctaaacggaaggtaaagaacgggtaacccgggaccgaacgggtacccgggtttaaaggggtttccgggggtttacggggtaacccggttaacggggttacccggggggaaacccggttaaacccgggggtaaccccgttacggggtaaccccgtacccgggtttaccctaccccgttaccgacccccggtttacccgaaccccgtaaaccccggggg

SEQ ID NO: 330889 - DNA, 612 bp, Homo sapiens
  misc_feature: GZ8MTXP02I1GWM.4.75.G09.1.454.CMB.2.raw
  modified_base (212)..(212): a, c, t, g, unknown or other
  misc_feature (212)..(212): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttcncactcagcactagcggagtgggtgtgggctggatccgtcacgcccccaggaaacggcctgggagtggcttggcactctatttagttggatgatgataagcgctacacgccatctcgtgatgaacacggctaccaccactaccaaccgaaacggaccgaaccctaaccgaaaaaccgacgggttacgtacccttaacgaatacgaacccaaacagtcgaccctgtacgaacacacgaccaactactacttactgagcacgagagaagccgggactagcgtaacggttgggttacggggtaccgttaacgggtccggggaccgtaacgggggtaacccctcgggtaacccgtacccgtaccgtttcccgtacgacccgttacccgaccccgtaaaaccccgg

SEQ ID NO: 330890 - DNA, 658 bp, Homo sapiens
  misc_feature: GZ8MTXP02IQN3A.4.75.G09.1.454.CMB.2.raw
  modified_base (637)..(637): a, c, t, g, unknown or other
  misc_feature (637)..(637): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctcgacctgctaccttctcgtgggttctcactcagcacgtaggcggtaggtgggtggtggggcgtggactccgtcacgccccgaggaacgccgtggagtgcttgctactctatttagtggatagatagataacgcgactacacgcctatctactgaagtagaacaggtcctaccgaaccactacaaaccgaaacggtacccgaccctaaacccgaaaacgtcgggttaccgtacccttaaacaacgtaccgaaacccaaacgtacgttaccggaacccgttcggaacggaaccaacgaaccgaccctaaactacgtttaacttaaccgtggtacgaccctaagaggtaacgacggtaccgggaacacggtacgtacggtttcgggggttacggggtcgtacgggtcggggaccgacggtacccgtcgtccgtaccgtcctaccgtacncccgtaccgaccgaaacccgg

SEQ ID NO: 330891 - DNA, 696 bp, Homo sapiens
  misc_feature: GZ8MTXP02ISDE9.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcctaccttctctgggttctcactcagcacgtaggcggtaggtgggtggtgggctggactccgtcacgccccgaggaacggcccgtggagtggcttgcactctatttagttggatgagtagataacgcgactacgacgcccactctctacgagtacgaacgacgctaccaccactaccgaaccgaacggaacccaccccgtaaacccgtaaaaaccggtcgggttaccgttaacccttaaacgtaaactaaccgaaccctaaacgacgtacccgggaccgtttcggaaccgggaacaccggacaacccgtaactaaactttagttacgttggtacgacaacggacggtagaaaccggttacgggacgacgtacgggttacggggttggggtttacgggggcctttacgggggacgggtacccggtaacggggtaaccccttggggaaccctacccgggttccttacccggtacgaaccctccccgttaacccgaaccccggg

SEQ ID NO: 330892 - DNA, 751 bp, Homo sapiens
  misc_feature: GZ8MTXP02IAHOG.4.75.G09.1.454.CMB.2.raw
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtcggttctacactcacgcagtaggcgggtaggtggggtggtggggctggacgtccgtcgaccgaccccgaagggaacggccgtaggnggtgtctgcactntatttgtggatgatagtaanagcgactacgcgcctactctacgttacgagtacgtaacggacggtaccctaccaaccctaccgtaacccgaaacccggaaacccggtaaccgaaacccccgtaaaccgtaaaaccggtacggttaccgttaccgtaaacaaacggtaccaaaccctaacgtaacgtccggtaaccgtaggacgtaccaccgtaacgaccctaactaaacttacgttaacgtcggtacgaaccgtaaaggaggtaacggtaacgggtaccggacggtaacggggttaccgtttaaccggggggttcgggggttttaccgggggcccggttacggggtaccgggggaccccggtaaccggggtcccggtaccgggtaacccgtacccgtccgtaccccgtaaccgttccccggaccctacccgggaaaccccgg

SEQ ID NO: 330893 - DNA, 672 bp, Homo sapiens
  misc_feature: GZ8MTXP02FLZ9G.4.75.G09.1.454.CMB.2.raw
  modified_base (357)..(357): a, c, t, g, unknown or other
  misc_feature (357)..(357): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcgggagtgggtgtggggctggatccgtcacgcccccgaggaaacggccctgggagtggcttgcactctatttagtgggatgatgataagcgctacacgccccatctactgatacgaacaggctccaacctanacccaaaccgaaacggacccgaccctaaacccgaaaaaccgtagggtcgtaccctttaaacaaagtacgaacccaaaactacgtacggtaaccccgttggacggaaccacaacggacccaaataattaactttacccgtgggtacgacccgtaaaagaaggtaagtaagttaggtcgggacgtaggtaccggttacggggtttcgggggttaccgggtaccggttaccgggtccgggggtaaccgtaaccgggggtaacccgtcggtaccccgtacccggttccttacccgtacgacccgtaccccgtaacccgg

SEQ ID NO: 330894 - DNA, 769 bp, Homo sapiens
  misc_feature: GZ8MTXP02FYUNU.4.75.G09.1.454.CMB.2.raw
  modified_base (377)..(377): a, c, t, g, unknown or other
  misc_feature (377)..(377): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggttcctcactcgacgactacgtaggcgggtaggttgggtggtcgggtcgtggtacgtccgtacgacccgaccccgaaagggaaccgccgtaggcggtcgtcgtcgacctactacttagtttggtaggtatagatagtaagtacgaccgtactacgacctacctntcgtacgtagtacgtacgaacgtacgcctaccgaacctacgtaaccaaaccggaaacggtaccccaaacccgtaaaacccgtaaaaccgggtcgttaaccgtaacccttaaacggaaactaaaccgtaacccaaacgtaacgtcccgtaacgttacggaaccgaaccactaacgaccctaaagttaacgttctacgtagacgaaccgtaaggacggtaacggtacggtaccggaacgtacgtaccggttagggggtttcgggggttacgggaccggttacgggggaaccggggtaacccggtaaaacccgggtcccggtttaccgaaaccccgggttcctttcccggtaaccgcccgtaacccgacccccgttaaacccggaaaccccgggg

SEQ ID NO: 330895 - DNA, 736 bp, Homo sapiens
  misc_feature: GZ8MTXP02HCW8N.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcagcactaggcggagtgggtgtgggctggatccgtcacgccccgaggaaacggccctggagtggcttggcactctatttagtggatgatgatagcgactacacgccatctctagatagaacacggtctacaaccactaccaaaccgaaacggtaacccgaccctaaacccgaaaaaacggttcggggtaaccgttaccctttaaaccgaaagttaccggaaaccctaaactaacggttccccggggtaaacccttagggttaaccgggaaccctaaacgaccggaccctaaacgtaacgtttaattaaaccggttggtacggaaccctaacgaaggtaacggtaacgttaaccgggggacctaacgggtaccggttacgggtttacgggggtttacgggggtaccgttaaacggggttccgggggaacccgtaaacgggggtaaccccttacggggtaacccgtaacccgttcccgtttacccgaccgaaccccgtcccgtttaaccccggaaaacccggg

SEQ ID NO: 330896 - DNA, 680 bp, Homo sapiens
  misc_feature: GZ8MTXP02H7EPY.4.75.G09.1.454.CMB.2.raw
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (527)..(527): a, c, t, g, unknown or other
  misc_feature (527)..(527): n is a, c, g, or t
tcagagcactgtagcacgaccggtgctcgatttagtatagacatcagggtcttcgtgactcctgtgcccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtggttctcactcagcacgtaggcgggtaggtgggtggtgggtcgtcggacgtcccgtcaccggcccccgaagggaaacggcccgtagggagtcggtcttgcctactactagtttagtaggatagatagaagtaacgcgtactacgacgacctatctntacgagtacgacgacgtcctaccaaccnctaccgaaaccgaaccggtaccctaacccgtaaccgaaaaccgtggtacccgttaacctaacaagtaccgaaccaagtaaacgtcggtaaccgtgtaacgacaccgtaacgcctaaacgtatacgtttacgngttacgaccaagacgagtacgacggacgtacgtaccggtagggttggggttacggacgttaacgggaccggggtaccgaaccgggttaccgtacggtaacccgtacccggttactacccgtacgaccccggtacctaaccccgaaaccccggg

SEQ ID NO: 330897 - DNA, 667 bp, Homo sapiens
  misc_feature: GZ8MTXP02I51PC.4.75.G09.1.454.CMB.2.raw
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
tcagagcactgtagcacgaccggtgctcgatttagtatagacatcaggggctgggcctcaggaagcagcatcggaggtgcctcagtcatggcatggatccctctcttcctcggcgtccttgcttactgcacaggatccgtggcctcctatgagctgactcagcccaccctcagtgtccgtcgtccccaggacagacagccagcatcagctgctcgtggagataagtggggatagtatgttgtggtatnancagagcaggccagtcccctgtcgctggtctatcttatatgactaccgagccgccctacgacgggacctcccgngacgcgtactttcgtacgtcggaccttacccaaacgttccgtaggggaaccaccgacgccctacttcgacgtaacccagtaccgaccggcccggaacccgtacgggtacctaggtagggaacgtcggacggtccgttagttaaccttacttaacgttccggtagacggggtaccggttacgggggacacgggtcgaaccggtaccgttaaccctacccgttacgtttaccggtttaacccgttccggaaccgtaccggtaaccgggggtaaccccgtaacggggttacccccgtaaccccggttcccggttaaaacggcccggtaaccccggtaaaccccccgg

SEQ ID NO: 330898 - DNA, 701 bp, Homo sapiens
  misc_feature: GZ8MTXP02GNYIF.4.75.G09.1.454.CMB.2.raw
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgaggacagacagccagcatcagctgctctaggaagtaagttaaaggttggggtaataaggttattggtttgttggtatcgagacaagaacgccacggcctacggtcccctggtcgcgtggtactatcttattatgaactacgacgccgtccctagacggtacctcccgtagacgtacgtactttccgtacgtcggtcctaccctaacgtcgtaacgggaaaccacaccgacccacttccgacgaaccctagtaccgacggaccccgggacccgtaagggaccttaggtacgggagtacggtacggtaccgtttagtaaacccgtttagttacccgtacgggttacggtaccggggtacggttaacgggggaacgacgtccgaacggtccctaaaacccgtttcccccgtaagttccggttcccgttacggaccgtaacccggttacggggaaaaccccttacgggtacccgtacccggtacccgttaaggacccgtaacccggaaaccccgg

SEQ ID NO: 330899 - DNA, 835 bp, Homo sapiens
  misc_feature: GZ8MTXP02INWK2.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgcgtaggtacgaaacccacacacgaccctcacgctcgacctgctaccttctcgtggttcctcactcagcagtaggcggtaggttgggtggtgggcgtcggacgtccgtcaccgaccccgaagggaacgccgtaggaggtcggtacgttcacgtaccttacgtagtttaggttagggtatggtaagtacgtaaagtaacggtcccggtacttaacgaccgtaccctattccgttactagtaactacggaaacgtcggtaccttaccaacctactaaccgaaaccgggtaaacccggtaacccgaaccccgttaaaaccgaaaaacccggttacgggttaaccggttaccctaaacgtaagtaaccggtaaccctaaacgttacggtacccggtaacccttagggtaaacgaacccgaacgtacccgaacttaaacgtaactttaacgttacgtttagaaccgtaacccgaaggtaacgtaacggttaacggaacggggtaacgtacgggttaccgggtttaccgggggtttagggggtttaccgggggtaacccggtttaacgggggacccgggggttaccgaaacccgggggttaaccccgttcggggtaacccttaaccccggggttcttccccgtacggtaaaccccgtccttaaaccccgggaaaaccccggg

SEQ ID NO: 330900 - DNA, 590 bp, Homo sapiens
  misc_feature: GZ8MTXP02HXP7E.4.75.G09.1.454.CMB.2.raw
  modified_base (336)..(336): a, c, t, g, unknown or other
  misc_feature (336)..(336): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctgatccgtcagcccccaggaaaggccctggagtggcttgcactcattattggatgatgataagcgctacagcccatctctgatgaacagctcacntcaaccaaaggaccgacctaccaaaaactaggtacgtaccttaacgaatagaaccaaacatacggacccttgacggacaacgagccaaactaacttaatttacctagtcacacgaagaagactaacgggacagtacgaacggttgggtttacgggggcttaaacggcgggggacccgaacgggggtaaacccttggggtaaccctaacccggttccttacccgaccgtaaccggcccctttacccgaaacccgg

SEQ ID NO: 330901 - DNA, 730 bp, Homo sapiens
  misc_feature: GZ8MTXP02FOVD0.4.75.G09.1.454.CMB.2.raw
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgccaccttctcgtggttctcactcagcactagcggaggtgggtgtgggctggactccgtcacgccccgaggaacgccgtggagtgctgctactctatttagtggatgatagagtagcgactacacgcctatctctagatagaacgacggacctaccaaccactaccgaaaccgaaacggtaaccccgaaccccgttaaaacccgaaaaaccgggtagggttaacccgttaccttaaaacgaaacgttaccggaaaacccaaacgttacgtaccggtaacctacgggttaacgaacccgaacgaaccgtaacccaaacttaacttaacttacgtttacgggacgaacctaaagaacggtaacggtaaaccggttacggggaccaagggtaccccggttaagggggtttccgggggtttagggggaccgtttacggggaccgggggacccgtaaaacccgggggcccgttacggaaccccggttaccccttaccggttcccacgtaccccggacccttaacccggaaacccccggg

SEQ ID NO: 330902 - DNA, 675 bp, Homo sapiens
  misc_feature: GZ8MTXP02JZM06.4.75.G09.1.454.CMB.2.raw
  modified_base (230)..(230): a, c, t, g, unknown or other
  misc_feature (230)..(230): n is a, c, g, or t
  modified_base (351)..(351): a, c, t, g, unknown or other
  misc_feature (351)..(351): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcacgctcgacctcgcctaccttcttcgttcgggttcctcacctnacgcaacgtacggcgggtaggtgggtggtgggtcgtcggtacgtccgtccgaccggaccccgaaggaaaccggtccgtggacggtggtcgttcgcctacgttacttagtttagtaggggtntagagtagtaagacgacggtactaaccgaccgtaccctacgtctccgtagtaacgtacgaaacgtacgtacaccaactacgaccaaaccgaaaccgtaccaaccctaaacccgaaaacgtcggtaacgttacccttaaacaagacgaaccaacgtagtccgaccgtgaacgacctagactcccaatnttaancgtagcaactacgaagtacggagtacggagacgtacggtacggggtttagggttcggaaacggtcggaaacggggtccgaacggtacccgttcggaaccgtctacctcgaccgacctccccgacgaacccgg

SEQ ID NO: 330903 - DNA, 682 bp, Homo sapiens
  misc_feature: GZ8MTXP02FKI6S.4.75.G09.1.454.CMB.2.raw
tcagagcactgtagcacgaccggtgctcgatttagtatagacatcagggtcttcgtgactcctgtgccccaccatggacacacttttgctccacgctcctgctgctgaccatcccttcatgggtcttgtcccagatcaccttgaaggagtctggtcctacgctggtacgaaacccacacagaccctcacgctgacctgcaccttctctgggttctcactcagcacgtagcggaggtgggtgtgggctggatccgtcacgccccgaggaaacgccgtggagtggctgcactctatttagtggatgatagataagcgactacacgccagtctcagatagaacacggctaccaacctactacccaaccgaaaggacccgaccctaaaaccaaaaacccgtagggttacgttaacccttaacaaactacgaacccaaactacgtaccggtaacccgtagggtacgaaccgaccgaacgaaccccaattaacttaagtttacgtacgtacgaccaaacgaggaacggtaacgtaccgggactaacgggacccggtacggtttcgggggtttacggggaccggttaacgggtacgggggacccggtaaccggggaacccgttcggggtaacccgttacccgttacccgttacccgtaccgtacgacccccgtaccgaaacccccgggg

SEQ ID NO: 330904 - DNA, 624 bp, Homo sapiens
  misc_feature: GZ8MTXP02GBCNZ.4.75.G09.1.454.CMB.2.raw
  modified_base (338)..(338): a, c, t, g, unknown or other
  misc_feature (338)..(338): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (528)..(528): a, c, t, g, unknown or other
  misc_feature (528)..(528): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcacttgaaggagtctggtcctacgctaggtacgaaacccacacacgaccctcacgctcgacctcgctaccttctcgtggttctcactcagactacgtaggcggtaggtgggtggtgggcgtggactccgtcaccggaccccgaaggaaccggccgtggagtgtctgccactctattagtggatgatgatacgcgactacgacnccgtatctcgagtaactacgaacgtacgactacaccgtactaaccgaaaccgtaacgggaccctacccctaaaaccgtaaaacggtacgggttaccgtaaccttaaacgacctacgaaaccctagtacgtaccgtaccgtacgacgacacgacnccaaatnttactactganacgagagagtacgcgacngtaccggtaggttggggtcgacggtacgggtacgggccgaacggtccgtacggccgtacccgtcgtacctccggacctacccgacccgtaacccgg

SEQ ID NO: 330905 - DNA, 671 bp, Homo sapiens
  misc_feature: GZ8MTXP02F5HR1.4.75.G09.1.454.CMB.2.raw
  modified_base (313)..(313): a, c, t, g, unknown or other
  misc_feature (313)..(313): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctcgacctgccaccttctctgggttctcactcagcacgtagcggagtgggtgtggggctggactccgtcacggccccgaggaacggcccgtaggagtcggcttggccactctatttagttgggntagatagtaagtaagccgtactacacgcccattctactgtactacgaacgacgctaccacgactaccaaaccggacggaccgaccctaaaccgaaaaccgtcgggtacgttaccctaaacaacgttacaaacctaacgacgtacgtacccgttaggacgaaccaccgacgtacccaataacgttattacgtagtagaccgagtaaggagaacgaccggggacacgggtacggttacgggttacgggggttcggtaccggtacggggtaccgggaacccggtaccggtacccggtaccgtaacccgtacccggtacccgttacccgtacccgtaccgtaccccgtaacccggaacccgg

SEQ ID NO: 330906 - DNA, 617 bp, Homo sapiens
  misc_feature: GZ8MTXP02FHLIM.4.75.G09.1.454.CMB.2.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtagaaacccacacacgaccctcacgctgacctgcaccttctctgggttcncactcagcactagcggagtgggtgtgggctggactccgtnacgcccccaggaaaggccctgggagtgggtcttcggctactctatttagttggatcatgataagcgtacacgtaccnccatctntcatagacgacgcctacacncgaccaaccgaacggaccaaccctaaaccaaaaccggtacgtacgttacctaacaacgtacgaaccaacgtacgaccggtaccgtgacgaacgacacgaccataacttatacgtcgtacgcgaacgaaggacgtacggaccggactacggtacgtacgggttggggttacgggtacgtaccgggtccgggacccgtaaccggggtacccgtacggtccgtacccgttccctacgtaccgaccgtaccccaaccgaaccg

SEQ ID NO: 330907 - DNA, 611 bp, Homo sapiens
  misc_feature: GZ8MTXP02GGPP1.4.75.G09.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
tcagagcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcagctgctctgganataaagtggggataagtatgttgtgtntnagcagagccaggccagtcccctgngctggtcatctatatgatacgagccgcctagaggacctccgtgacgcgttacttctctggtcctacctaacgttccgtacggggaaccacgaccgcctaaactccgtacgaacccatacccgacgtacccgggggaacccgtagggtacctaggtacggtagtacggaggtcgttacgtaaacttacgtttaccgtacgtacggtacgggtacgggtacggaacgacggacgaaacgtcctacccgttacctacgtttccgtccgttaccgacgtacccggtacgggaaccgtaccggttaccgtaccggttcgaacgggtacccgaacccgaaccccg

SEQ ID NO: 330908 - DNA, 673 bp, Homo sapiens
  misc_feature: GZ8MTXP02GA31D.4.75.G09.1.454.CMB.2.raw
  modified_base (465)..(465): a, c, t, g, unknown or other
  misc_feature (465)..(465): n is a, c, g, or t
  modified_base (546)..(546): a, c, t, g, unknown or other
  misc_feature (546)..(546): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgaccctcaccgctcgacctgcctaccttctcgttggttctcacctcgacgcacgtaggcgggtaggtgggtggtgggcgtggacgtccgtcaccgaccccgaagggaacgccgtaggagtggtctgcctactctatttagttggatgagtagtagtaacgcactacacgcctatctctagacgtagaacgtacggactaccaactaccgtaccgaaaccggaaaccggaccgtaacccccgtaaaacccgaaaaaccggtagggtttacccgttaacccttaaanaaacgttaccggaaaccctaaactaccggaccggtaccgtagtacgaaaccgacgtaaccaccaactaatttaacgttacngggtacacgaacgaacggagtacggacgtacgagcggttaacggttggggtcgacgttacgggcggaccgtacggtaccgtcggtaaccgtccgtaccttccaccgaccgacccgtacgaaccccgg

SEQ ID NO: 330909 - DNA, 591 bp, Homo sapiens
  misc_feature: GZ8MTXP02IAX40.4.75.G09.1.454.CMB.2.raw
  modified_base (117)..(117): a, c, t, g, unknown or other
  misc_feature (117)..(117): n is a, c, g, or t
  modified_base (145)..(145): a, c, t, g, unknown or other
  misc_feature (145)..(145): n is a, c, g, or t
  modified_base (175)..(175): a, c, t, g, unknown or other
  misc_feature (175)..(175): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
  modified_base (545)..(545): a, c, t, g, unknown or other
  misc_feature (545)..(545): n is a, c, g, or t
tcagagcactgtagcacgaccggtgctcgatttagtatagacatcagggtcttcgtgactcctgtgccccaccatggacacactttgctccacgctcctgctgctgaccatcccttnatgggtcttgtccagatcacttgaaggngtctggtcctacgctggtacgaaaccccanacacgaccctcacgctgacctgcctaccttcgtcgttggttctcactcagcagtaggcggtaggtgggtgtgggctggactcgtacgacgaccccgaggaacgccgtggagtcgcttgactacttagtattttagtgggtatgtactagaagtaacgcgactacacncccgtatccgtnacgatagacgcgtactcgacncgacgaacgacgaccgtaacccacgaaaaccgtgggtactacctaanactacgacanacgtgtaccagcgacaagcttacactattatancgtacagtaacganagtcgaacgcgacgtacgtcgggtttggttcgggaaccttacgggacggtaaccgcgggttaaccnccggaacctacccgtactcccgactaccggacccctacggaacccg

SEQ ID NO: 330910 - DNA, 750 bp, Homo sapiens
  misc_feature: GZ8MTXP02I5FSY.4.75.G09.1.454.CMB.2.raw
  modified_base (327)..(327): a, c, t, g, unknown or other
  misc_feature (327)..(327): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctgggttctcactcagcactagcggaggtgggtggtgggctggatccgtcacgccccaggaacgcctggagtggcttgcacgtctatttagtggatgatgataagcgctacgacgccatctcncgatacgaacacgctacaccataccaaccgaaacggaccgacccgtaaaccgaaaaaccgtacgggttaaccgttaccctttaaacgaacttaacgaaacccgtaaaacgtacggtaccggaaccccgtttagggtaccgggaaaccaaccgtaaccggaaacccctaaaccttaaatttaaacgtttaccccgttaggtaccggaccaaaaccggtaaggtaaaccggtaacggtaaccccggggagaacgggtacccggtttaaagggggtttcgggggtttacgggggtacccggttaaccggggttaccggggggtaccccgaaaaaccgggggttacccccgttaggggtcccccgtaaaccccggttcccgtaccccgttaccgaacccggtcccccgttaacccgaaaccccgggg

SEQ ID NO: 330911 - DNA, 786 bp, Homo sapiens
  misc_feature: GZ8MTXP02JZCVF.4.75.G09.1.454.CMB.2.raw
  modified_base (369)..(369): a, c, t, g, unknown or other
  misc_feature (369)..(369): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtacgaaacccacacacgacccctcacgctcgacctgcctaccttctcgtggttctcactcagcacgtaggcggaggtggggtgtagggctggactccgtcgaccgaccccggaagggaaacggccctgggacgtcggtcttggctactactatttagttggatgatagatacgcactacacgccctatctactagtatacgaacncggtactaccgaaccacctaccaaacccgtaaaccgggaccctaaccccgtaaaaccccgaaaaaccgggtcgggttaccggttaccctttaaacaaacgtaaccgaaaccctaaacgtacgtacccggggtaacccgttacgggtacgaacccgaccgaaccggtaccctaaacgttaattaaccgtttacgtacggtacgacccaaggaacggtaacggtacggtaacccggggacaaccggggtccggttacggggtttacgggggtttacgggggacccggtttaaccgggggaccgggggtaacccgggtaaaccgggggtaaccccggtttaccgggaaccccgttaccccggttcccgttaccccgtaccccgtacccggtacccccgttaacccccgaaacccccgggg

SEQ ID NO: 330912 - DNA, 685 bp, Homo sapiens
  misc_feature: GZ8MTXP02HDUIK.4.75.G09.1.454.CMB.2.raw
  modified_base (177)..(177): a, c, t, g, unknown or other
  misc_feature (177)..(177): n is a, c, g, or t
tcagagcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgcgtggtacgaaacccanacacgaccctcacgctgacctgctaccttctctggttctacactcagcacgtaggcggagtgggtgtgggctggatccgtacgaccgccccgaaggaaacggccctggacgtggcttcggcactctatttagtggatgatagagtaagcgtacgtacacgcccaatccgtcgtgaatagaacacggtcaccacactcgaaaccaaggtaaccacccgttaaccaaaaccgtacgtacgttaacccgtaactaaactacgaaaccaaactacgtaccggtaaccccgttacggaccggaacctaccggaaacgacccgtaaacctaactttaaacgtacccgtttaagggtaccgaaactaaccgaaacggtagaaacggttaccggacgacggtaccgttaacgggtcggggttttacggaccgttaacgggtcgggaaccgaccgggaaacccgtcgggtaacctaccggtacccttccggtacaccgtaccgtaacccaaccccgg

SEQ ID NO: 330913 - DNA, 436 bp, Homo sapiens
  misc_feature: GZ8MTXP01AHYPU.10.42.D09.1.454.CMB.2.raw
  modified_base (431)..(436): a, c, t, g, unknown or other
  misc_feature (431)..(436): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccccgagagcacagcggccctgggctgcctggtcaaggctacttcccactactatgctgagcgggctgggccaaggcgcatagggnnnnnn

SEQ ID NO: 330914 - DNA, 441 bp, Homo sapiens
  misc_feature: GZ8MTXP01EEBLW.10.42.D09.1.454.CMB.2.raw
  modified_base (437)..(441): a, c, t, g, unknown or other
  misc_feature (437)..(441): n is a, c, g, or t
tcagcatagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactccgtgggccagggaatcctggtcaccgtctcctcacgcctccaccaagggccccatccggtccttccccctggccgcccctgcctccaggacgcacctccccgagagcacacgccggccctgggctgcctggtcaagggctacttcccactactatgctgagcgggctggcaaggcgcataggnnnnn

SEQ ID NO: 330915 - DNA, 433 bp, Homo sapiens
  misc_feature: GZ8MTXP01EQL01.10.42.D09.1.454.CMB.2.raw
  modified_base (428)..(433): a, c, t, g, unknown or other
  misc_feature (428)..(433): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgttgactccgtggggccagggaatcctggtcaccgtctcctcagcctccaccaaggggcccatcggtccttccccctggccgccctgctccagagccacctcccgagagcacacgcggccctgggctgcctggtcaacggactactcccatacatgctgagcgggctggcaagcgcataggnnnnnn

SEQ ID NO: 330916 - DNA, 435 bp, Homo sapiens
  misc_feature: GZ8MTXP01A1LL7.10.42.D09.1.454.CMB.2.raw
  modified_base (429)..(435): a, c, t, g, unknown or other
  misc_feature (429)..(435): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggccccatccggtcttccccctggccgccctgctccaggacgcacctcccgagagcacagccgccctgggctgcctggtcaaggctactcccactactatgctgagcgggctggcaaggcgcataggnnnnnnn

SEQ ID NO: 330917 - DNA, 429 bp, Homo sapiens
  misc_feature: GZ8MTXP01AQBD7.10.42.D09.1.454.CMB.2.raw
  modified_base (424)..(429): a, c, t, g, unknown or other
  misc_feature (424)..(429): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcctcccctggcgccctgctccaggagcacctcccgagagcacagccggccctgggctgcctggtcaaggctactcccatactatgctgagcgggctggcaaggcgcataggnnnnnn

SEQ ID NO: 330918 - DNA, 430 bp, Homo sapiens
  misc_feature: GZ8MTXP01D47U1.10.42.D09.1.454.CMB.2.raw
  modified_base (426)..(430): a, c, t, g, unknown or other
  misc_feature (426)..(430): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttcccctggcgccctgctccaggagcacctcccgagagcacagccggccctgggctgcctggtcaaggctacttcccatactatgctgagcgggctggcaaggcgacataggnnnnn

SEQ ID NO: 330919 - DNA, 433 bp, Homo sapiens
  misc_feature: GZ8MTXP01C477P.10.42.D09.1.454.CMB.2.raw
  modified_base (418)..(419): a, c, t, g, unknown or other
  misc_feature (418)..(419): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (427)..(428): a, c, t, g, unknown or other
  misc_feature (427)..(428): n is a, c, g, or t
  modified_base (431)..(433): a, c, t, g, unknown or other
  misc_feature (431)..(433): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaagggctggttacatgttgactcctggggccaggatcctggtcaccgtctcctcacgcctcccaccaaacgggccccatccggtccttccccctggccgccctgcctccgaggacgcacctcccgagagcacagccgccctgggctgcctggtcaaggactacttcccatacatgctgagcgggnngngagngnnagnnn

SEQ ID NO: 330920 - DNA, 514 bp, Homo sapiens
  misc_feature: GZ8MTXP01COFRS.10.42.D09.1.454.CMB.2.raw
  modified_base (327)..(327): a, c, t, g, unknown or other
  misc_feature (327)..(327): n is a, c, g, or t
  modified_base (499)..(514): a, c, t, g, unknown or other
  misc_feature (499)..(514): n is a, c, g, or t
tcagcatagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaagggctggtacatgttgactccgtgggccaggatccgtggtcaccgtctcctcagcctccaccgaacgggccccatccggtccttccccctggccnccctgcctccgacgacgccaccgtccccgaggacgcaccgacggcccgggcccgtcggggcctcggtcccgtcgggtaccgaaacgggtacccttaacccttccccaaacgttactacgttgccgttagggacgggtccggggactgggacgaaacgggctaccgagacggnnnnnnnnnnnnnnnn

SEQ ID NO: 330921 - DNA, 500 bp, Homo sapiens
  misc_feature: GZ8MTXP01DXBRV.10.42.D09.1.454.CMB.2.raw
  modified_base (490)..(500): a, c, t, g, unknown or other
  misc_feature (490)..(500): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaaggctggttacatgttgactcgtgggccaggatcgtgtcaccgtctcctcacgcctccaccgaacgggcccctagtcccggtcccttccccccgtgggcccgcccctgcctccgacggacgccaccctccccgagacgccaccgacggccccggcccgtcgggctcgtcccgtacggtaccgaacgggtaccttacccttacccaacttactagtcgcgtaggacgggccgggctcgggacgaacggcgacagtaggnnnnnnnnnnn

SEQ ID NO: 330922 - DNA, 507 bp, Homo sapiens
  misc_feature: GZ8MTXP01A7NFX.10.42.D09.1.454.CMB.2.raw
  modified_base (495)..(507): a, c, t, g, unknown or other
  misc_feature (495)..(507): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaggctgttacatgttgactcgtgggcaggatccgtgtcaccgtctcctcacgcctccaccgaacgggccccacgtcccggttcccttcccccgtcggccccgtcccctcgcctcccgaggcgccaccctcccgagacgccacgacgcccgggcccgtgggccgtcgcccgtacggtaccgaaacgggtaccttacccgttaccccaacttactagtcgtctcgggacggccggggtactcgggacaacgggccgataagtgggnnnnnnnnnnnnn

SEQ ID NO: 330923 - DNA, 564 bp, Homo sapiens
  misc_feature: GZ8MTXP01DHT4Z.10.42.D09.1.454.CMB.2.raw
  modified_base (549)..(564): a, c, t, g, unknown or other
  misc_feature (549)..(564): n is a, c, g, or t
tcagcatagtagtgcacgaccggtgctcgattttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtggaggatcgtccccccaagaaagggctggttacattgtttgacgtccgtggggaccgaagggtaactccgtggtcctacccgtccttccctcacgcccctcccaaccgaaccggggcccctacgtcccggttccccttccccccgtcgggcccgtccccgtcgccctaccgacggccgaccctacccgtacccccgagacgccaacccgacggcccgtccccgtcgggaccgtcgtacccgtcggtaaccgtaacgggtaaccttaccccgttacccaacttactacgtgaccggtgacggggccggctaggggaccacgggccactagacggnnnnnnnnnnnnnnnn

SEQ ID NO: 330924 - DNA, 444 bp, Homo sapiens
  misc_feature: GZ8MTXP01C86AJ.10.42.D09.1.454.CMB.2.raw
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (432)..(444): a, c, t, g, unknown or other
  misc_feature (432)..(444): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatgtccccccagaaaggctggttacatgttgactcctggggccagggaanccgtggtcaccgtctccgtcacgcctccaccagggcccatccgtcttcccctggcnccctgctcagancacctccgagancacacgccgcccgtgggctggcctggaccaaggtactacctcccatactncgntggagcgggtcngggcaaaggcacatagggnnnnnnnnnnnnn

SEQ ID NO: 330925 - DNA, 438 bp, Homo sapiens
  misc_feature: GZ8MTXP02J2ZH2.10.42.D09.1.454.CMB.2.raw
  modified_base (356)..(356): a, c, t, g, unknown or other
  misc_feature (356)..(356): n is a, c, g, or t
  modified_base (433)..(438): a, c, t, g, unknown or other
  misc_feature (433)..(438): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggccccatcggtcttccccctggccgccctgcctccaggagcacctccccgagngcacagcggccctggggctgccctggtcaaggactacttcccactactatgctgagcgggctggccaggcgcatagnnnnnn

SEQ ID NO: 330926 - DNA, 440 bp, Homo sapiens
  misc_feature: GZ8MTXP02H6B9U.10.42.D09.1.454.CMB.2.raw
  modified_base (402)..(402): a, c, t, g, unknown or other
  misc_feature (402)..(402): n is a, c, g, or t
  modified_base (436)..(440): a, c, t, g, unknown or other
  misc_feature (436)..(440): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatgtccccccagaaaggctggttacatgttgactcctggggccagggaatcctggtcaccgtctcctcacgccctccaccaagggcccatccggtccttccccctggccgcccctgctccaggacgcacctcccgagacgcacacgccggccctgggcctgcctgtcaacggactacctcccanactatgctgacgcggggctggcaggcgacatagnnnnn

SEQ ID NO: 330927 - DNA, 493 bp, Homo sapiens
  misc_feature: GZ8MTXP02GOG5A.10.42.D09.1.454.CMB.2.raw
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (478)..(493): a, c, t, g, unknown or other
  misc_feature (478)..(493): n is a, c, g, or t
tcagcatagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgacaaatgaacagcctgagagccgagacacggctgtatattactgtgtgaggatcgtccccagaaggctgtacatgttgactcgtggcaggatccgtgtcaccgtctcctcacgtccctccaaccgaacgggcccctacgtccggtccccttcccccgtggcccgcccctcgcctccgacggacnccgtaccncccgagacgacacgacggcccgtccgtgggcctcgccgtacgtaccgaacgtaccttaccctacccaactactacgtcgcgtggacgccgggcacggggacaaagggccctaaananagnnnnnnnnnnnnnnnn

SEQ ID NO: 330928 - DNA, 481 bp, Homo sapiens
  misc_feature: GZ8MTXP02G9Y9U.10.42.D09.1.454.CMB.2.raw
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (472)..(481): a, c, t, g, unknown or other
  misc_feature (472)..(481): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccaagaaagggctggttacatgttgactcgtggggccagggatcctggtcaccgtctcctcncgcctccaccgacgggcccagtccggtccttccccgnggccgccctgcctccgaggacgccacctccccgagacgccacacggccggcccgtggggcctcggcccgtggtccgaacggtaccttacccgtccccaattacctatcggcgtggacggccggggctgggacaacggcgactagnnnnnnnnnn

SEQ ID NO: 330929 - DNA, 537 bp, Homo sapiens
  misc_feature: GZ8MTXP02FPHEJ.10.42.D09.1.454.CMB.2.raw
  modified_base (283)..(283): a, c, t, g, unknown or other
  misc_feature (283)..(283): n is a, c, g, or t
  modified_base (520)..(537): a, c, t, g, unknown or other
  misc_feature (520)..(537): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaaggctggtacatgttgactcgtggggccaggatccgtggtcaccgtctccncacgcctaccaccgaacgggcccagtccggttccttccccctcggcccgcccctgcctcccgacggacgcccgaccctccccgacgacgacaaccgacggcccggccccgtggggtccgtcggcccgtcgggttaccgaaacggacccttaacccgtttacccccactttaaaccctagttcggacccttgggacgggccggggtcgtacggggacgaaacgggcgaaccagtaagnnnnnnnnnnnnnnnnnn

SEQ ID NO: 330930 - DNA, 530 bp, Homo sapiens
  misc_feature: GZ8MTXP02IENRE.10.42.D09.1.454.CMB.2.raw
  modified_base (242)..(242): a, c, t, g, unknown or other
  misc_feature (242)..(242): n is a, c, g, or t
  modified_base (506)..(506): a, c, t, g, unknown or other
  misc_feature (506)..(506): n is a, c, g, or t
  modified_base (508)..(530): a, c, t, g, unknown or other
  misc_feature (508)..(530): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtccccagaaggctggttacntgttgactcgtgggccaggatcctgtcaccgtctcctcacgccctccaccaacggggccccagttccggtcccttccccccgtggcccgtcccctcgcctcccgaggacgccacctccccggagacgcaacacggcccgggtcccgtggggccgtacgcccgttcgggtaccgaaacgggtaccttacccgttacccctaacttaaaccttacgtacgccgttacggacggtccggggcgtcgggacgaacgggcgacagtagngnnnnnnnnnnnnnnnnnnnnnnn

SEQ ID NO: 330931 - DNA, 474 bp, Homo sapiens
  misc_feature: GZ8MTXP02HWUWZ.10.42.D09.1.454.CMB.2.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (450)..(474): a, c, t, g, unknown or other
  misc_feature (450)..(474): n is a, c, g, or t
tcagcatagtagtgcacgaccggtgctcgatttagacacatacgcagggaaaggggctggagtgggtctcgactattaatggtcttgctgataatacacactacgcagacttcgtgaaggccggttcaccatctcgagagacaacaccaagaacacgctgaatctgcaaatgaacagcctgagagccgaggacacggctgtatattactgtgtgaggatgtcccccagaaaggctggttacattgttgactccgtggggccaaggatcctggtcaccgtctccctcgacnccnccaccaaacgggcccatccggtcctcccccgtgccgccctgctccagancacctccgagcgcacagccgcctggggctcnccgtgtccaaagggccttaccgttacccaaactacgtaatcgactgacggtcccgggatcgggcaggcgacagtagnnnnnnnnnnnnnnnnnnnnnnnnn

SEQ ID NO: 330932 - DNA, 513 bp, Homo sapiens
  misc_feature: GZ8MTXP01B8J7L.4.9.A09.1.454.CMB.2.raw
  modified_base (292)..(292): a, c, t, g, unknown or other
  misc_feature (292)..(292): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtgttttctaggtggctaatttaaaggtgtcagtgtgaggtgcagttggtggagtcgtgggggagcttggtacagccgtggggggtccctgagactctcctgtacagactctggattcacctttagcagccatgcatgagctgggtccnccaggctcgagggaagggctggagtgggtctcgagctaaagttgtggaggtggtggtggtgtacatactaacgcaactcgnggacggggcattcaccatccncananacatacaanactatatatntananaanagacacgcgcgcgacgacgacgacgacgtacgtatactntgtgacgtattgtactgttcgcgacgaagcgtcgngngngtcgttgtg

SEQ ID NO: 330933 - DNA, 533 bp, Homo sapiens
  misc_feature: GZ8MTXP01AXK6S.4.9.A09.1.454.CMB.2.raw
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (427)..(427): a, c, t, g, unknown or other
  misc_feature (427)..(427): n is a, c, g, or t
  modified_base (450)..(450): a, c, t, g, unknown or other
  misc_feature (450)..(450): n is a, c, g, or t
  modified_base (518)..(518): a, c, t, g, unknown or other
  misc_feature (518)..(518): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtggtcttttctagtggctattttaaaaggtgtcagtgtgaggtgcagttggtggagtcgtgggggaggcttggtacagccgtggggggtccctgagactctcctgtacagactctggattcacctttagcagccatgccatgagctgggtccncaggctccgagggaggggctggagtgggtctcagcaattaggnggaggtggtggtggtggtacatactaacgctaacgtccgtggacggggccgattcaccatctccagagacaattccaaagacacgttanaatctagacaataggaacagacncgcgacgcgacgacgacgccgtactacttactgtgagtaagttagtcttacttcgcgacgaagcgcgngagttggtcgttgtg

SEQ ID NO: 330934 - DNA, 654 bp, Homo sapiens
  misc_feature: GZ8MTXP01C33VM.4.9.A09.1.454.CMB.2.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtgttttctaggtggctaattttaaaaggtgtccagtgtgaggtgcagttggtggagtcgtgggggagcttggtacagccgtgggggtccctgagctctcctgtacagtactctggattcacctttagcagccangcatganctggccncaggctcgagggaagggctggagtgggtctanagntaaatttgggngggtaggtggtggtacggtagtactagtacgaacgaactaacgtcggtagggacgggtactacgtacaacctactcctacgaagaacgtaactaaacgttaaccgaaagtaaacgtaacgttaactacttactacgaactaaactaacggaaacgtaacgaccgtacgacgaccgaccgaaccgaaccgaaccggtaccgttaacttaacgttaacgttaagtacgttaacgtaaacgttacgttacgttacgttacggttacggaccggtaacggtacggtaacggtacgtacggttacggtcggttcggtaacg

SEQ ID NO: 330935 - DNA, 575 bp, Homo sapiens
  misc_feature: GZ8MTXP01EJGT7.4.9.A09.1.454.CMB.2.raw
  modified_base (334)..(334): a, c, t, g, unknown or other
  misc_feature (334)..(334): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtcgtgggggagcttggtacagccgtgggggtccctgagactctcctgtacagactctggattcactttagcagccatgccatgagctggtccgccaggctccgagggagggctggagtggtctcgagcaattaggnggtagggtggtggtggtaggtacatacgtaacgacaacgtccgtggacggggccgtattcgacctatcctaccaagagactaataccaaagaactacgttatatctagactaaatggaaaccagcctagacgacgacccgacgaaccgtacggtaccgtaattacttaacgtgtagacgaaagttgaccgtttagttcgccgaccggtaagcgtaagcgaggttcggtcgttgggtaaccg

SEQ ID NO: 330936 - DNA, 596 bp, Homo sapiens
  misc_feature: GZ8MTXP01BPVQM.4.9.A09.1.454.CMB.2.raw
  modified_base (300)..(300): a, c, t, g, unknown or other
  misc_feature (300)..(300): n is a, c, g, or t
  modified_base (571)..(571): a, c, t, g, unknown or other
  misc_feature (571)..(571): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagttggtggagtcgtgggggaggcttggtacagccgtggggggtccctgagactctcctgtacagactctggattcactttagcagccatgccatgagcgtgggtcccnccgaggcctccgagggaaggggctggaggtgggtctcgagctaagttaggtggaggtgggtcggtggtggtacatacgtaacgacaacgtcgaggacggggccattcacatctaccagacgactaaacttccgaaagtaactacgttatatcagacaaatagaactacggcctaggaccgtagcccgaacgaccgaccgggtccgttaattacttacgtggtagttactaaagttcgtaccctttaagttcggccgaccggtaagcgtcgngaggttcggtccgttggggtaaccg

SEQ ID NO: 330937 - DNA, 567 bp, Homo sapiens
  misc_feature: GZ8MTXP02JWEWF.4.9.A09.1.454.CMB.2.raw
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtgtttctagtggctatttaaaggtgtccagtgtgaggtgcagttggtggagtcgtgggggaggcttggtacagccgtgggggtccctgagactctcctgtacagactctggattcacctttagcagccatgccatgngcgtcggtcgcgngcgcgagggaggngtggaggtggtcgtcgagatagtagtggtaggtggtggtggtgtacgtacgtacgtacgacgtacgtacgtacggacgggacgtactacaccactacctaccgagaacgaacaactaacgaaacgaaacgtaacgttaatactactacgaacaaataacgaacgacgacgcgacgacgacgacgacgacgacgtatatagtcgtagagtacgtacgtacgtacgtcgacgacgaacgacgtacgacgagtcgtcgtgtcg

SEQ ID NO: 330938 - DNA, 570 bp, Homo sapiens
  misc_feature: GZ8MTXP02J1OGT.4.9.A09.1.454.CMB.2.raw
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtcgttttctaggtggctaattttaaaaggtgtccagtgtgaggtgcagttggtggagtcgtgggggagcttggacagccgtgggggtccctgagactctcctgtacagactctggattcacctttagcagccatgccatgagctgggtccncaggcnccgagggaacggggngnggnggtggtcgtgagatagtagtggtggtggtggtggtgtacgtatacgtacgacgacgtacgcggacggcgtactacacactactacgagacgaactaactaacaacgaactaacgtactactactactaactaaagtacgaacgacgacgtagtacgacgaccgacgacgacgacgtactactactacgtagacgtacgtacgtacgtacgtacgacgacgaacgacgtacgacgtagtcgtcgtcgtcg

SEQ ID NO: 330939 - DNA, 569 bp, Homo sapiens
  misc_feature: GZ8MTXP02IE3J3.4.9.A09.1.454.CMB.2.raw
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggcttttcttgtggctattttaaaaggtgtccagtgtgaggtgcagttggtggagtcgtgggggaggcttggtacagccgtgggggtccctgagactctcctgtacagactctggattcacctttagcagccatgccatgagctgggtccgccaggctccgagggaaggggctggagtgggtctcgagcaattaggtggaggtggtggtggtggtacatactacgcaacgtccgtgacggggccgattcacatctcagagacaattccaaagaacacgttatactctagactaaatagaaactagaccctggacgacgacccggaacgaaccgacgggtacccgtaataactttaaccgtggtacgaccgtaaaattcggaccctttagttcgacgaccgaagcgtaagcgaggttcggcgtggtcg

SEQ ID NO: 330940 - DNA, 534 bp, Homo sapiens
  misc_feature: GZ8MTXP02HL2DG.4.9.A09.1.454.CMB.2.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagttggtggagtcgtgggggaggcttggtacagccgtggggggtccctgagactctcctgtacagactctggattcacctttagcagccatgccatgagctgggtccgccaggctccgaggggaagggctggagtgggtctcgagcaaagttaggtggaggtggtggtggtggtacatactacgacacgtccgtggacggggccgatcacatcncaganacatccaagacatatatctananaananacagcgcgacgacgacgacgacgacgacgtatatactcgtagacgtaactacgtactacgtcgtacgacgaacgacgtacgacgagtcgtcgtcgtcg

SEQ ID NO: 330941 - DNA, 625 bp, Homo sapiens
  misc_feature: GZ8MTXP02GAFGW.4.9.A09.1.454.CMB.2.raw
  modified_base (356)..(356): a, c, t, g, unknown or other
  misc_feature (356)..(356): n is a, c, g, or t
tcagagcactgtagcacgaccggtgctcgatttagcgagacgcgcaggggagagaggagcccagccctgggattttcaggtgtttcatttggtgatcaggactgaacagagagaactcaccatggagtttgggctgagcgtggcgttttcttagtggctattttaaaaggtgtccagtgtgaggtgcagttggtggagtctgggggaggcttggtacagcctggggggtccctgagactctcctgtacagactctggattcaccttagcagccatgccatgagctgggtccgccaggctccagggaaggggctggagtgggtctcagcaattagtggaggtggtggtggtggtaanatactacgactacgtcgaggacgggccgtatcacctactcctaccgaagagaactaaattaccgaaaagaaactaacgttaataatactacgtaacgtaaataacgaaacgaacgaccgtacgacgaccggaccgaaccggaaccgaaccggaccggtaacgttaacgttaacgttacgtacgtaacgtaaacgtacgttaccgttacgttacgtaccggaaccggaacggtacggtacggtacgtacggtacggtacggtacggtacg

SEQ ID NO: 330942 - DNA, 521 bp, Homo sapiens
  misc_feature: GZ8MTXP02FXBQI.4.9.A09.1.454.CMB.2.raw
  modified_base (430)..(430): a, c, t, g, unknown or other
  misc_feature (430)..(430): n is a, c, g, or t
  modified_base (470)..(470): a, c, t, g, unknown or other
  misc_feature (470)..(470): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggcttttcttgtggctattttaaaaggtgtccagtgtgaggtgcagttggtggagtcgtgggggaggcttggtacagcctgggggtccctgagactctcctgtacagactctggattcacctttagcagccatgccatgagctgggtccgcaggctccagggaagggctggagtgggtctcagcaaatagtggaggtggtggtggtggtacatactacgcaactccgtgaggggccagttcaccatctccagagacaattccaagaactacgttatatctgacaaatnaacagcctgcgagccgacgactacggcctaatacgttacngtagcgaaaatgaccttatcgacgaccgaagccgtaagcagtcggctggtg

SEQ ID NO: 330943 - DNA, 544 bp, Homo sapiens
  misc_feature: GZ8MTXP02H0XLH.4.9.A09.1.454.CMB.2.raw
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtcgttttctaggtggctatttaaaaggtgtcagtgtgaggtgcagttggtggagtctgggggaggcttgggtacagccgtggggggtccctgagactctcctgtacagactctggattcacctttagcagccatgccatgagctggtccgccaggctccagggaaggggcgtgggnggtggtcgtcgaganagtagtggtggtggtggtggtgtagtatactacgacacgtcgtcggacgggcgacgtcacactctcagagacaactacaagaactacgtatatatnanaatagaacgacgctcgcgacgcgacgacgacgacgtactacttagtacgtgagtaacgtacgtacttacgtacgtacgacgaacgcgtacgacgacgtcggtcgtcggtcg

SEQ ID NO: 330944 - DNA, 643 bp, Homo sapiens
  misc_feature: GZ8MTXP02H7YSE.4.9.A09.1.454.CMB.2.raw
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtgttttctaggtggctaattttaaaaggtgtcagtgtgaggtgcgagttggtggagtcgtgggggagcttggacagccgtgggggtcctggagctctcctgtacagactctggatcactttagcagccatgccangngcgtcggcgcgcgcgcgaggaggcgtggnggtggtcgtcgagagtaagtaggtaggtggtgggtgggtggtaggtacgtacgtaacgtacgaacgtaccgtacggtacgggacgggtacgtacgtaccgtacctactacctaccgaagaacgaactaaacgtaacgtaaacgtaaacgtaacgttaactaactacgtaacgaactaaagtaacgaacgaacgacgacgacgacgaccgaaccgaaccgaaccggtaaccgtaacgtaacgttacgtacgtacgtaacgtaaacgtacgtacgttacgtacgtacgaccggtaacggtacgtaacgtacgtacggtacggtcggtacggtacg

SEQ ID NO: 330945 - DNA, 579 bp, Homo sapiens
  misc_feature: GZ8MTXP02IG0TO.4.9.A09.1.454.CMB.2.raw
  modified_base (301)..(301): a, c, t, g, unknown or other
  misc_feature (301)..(301): n is a, c, g, or t
  modified_base (450)..(450): a, c, t, g, unknown or other
  misc_feature (450)..(450): n is a, c, g, or t
tcagagcactgtagcacgaccggtgctcgatttagcgagacgcgcagggggagagaggagcccagccctgggattttcaagtgttttcatttggtgatcaggactgaacagagagaactcaccatggagtttgggctgagcgtggtcttttcttaggtggctaattttaaaaggtgtccagtgtgaggtgcagttggtggagtcgtgggggaggcttggtacagccgtggggggtccctgagactctcctgtacagactctggattcacctttagcagccatgccatgagcgtcgggtccnccaggctaccgaggggaaggggcctaggaggttcgggtctcgaggctaaagtagtgggaggtggtgggtggtggtacatactacgactaacgtccgtaggacgggggccattcactatctcagacgacaatccaaagactacgttaatntactagactaaaatacgaactaacgcccgtagaccgacgaccgacaacgacggaccgtatacttaacgtgtacgacgtaaaatcgtaccttagtacgacgaccgaagcgtaacgcaggtcgctgggtac

SEQ ID NO: 330946 - DNA, 595 bp, Homo sapiens
  misc_feature: GZ8MTXP02FP5QJ.4.9.A09.1.454.CMB.2.raw
  modified_base (342)..(342): a, c, t, g, unknown or other
  misc_feature (342)..(342): n is a, c, g, or t
tcagagcactgtagcacgaccggtgctcgatttagcgagacgcgcagggggagagaggagcccagccctgggattttcaggttgttttcatttggtgatcaggactgaacagagagaactcaccatggagtttgggctgagctggtctttttcttgtggctattttaaaaggtgtccagtgtgaggtgcagttggtggagtcgtgggggaggcttggtacagccgtggggggtccctgagactctcctgtacagactctggattcacctttagcagccatgccatgagctgggtccgccaggctccgaggggaagggctggagtgggtctcagctaattagngggaggtggtgggtggtggtacatactacgacaacgtccgtaggacgggggccgtattcacctatccctaccaagaacgaacaaacttaccaaaagaaccaacgtttaatactctagacaaaatagaaacagtaccctaggacgaacgacccgaacgtacgaacggtccgtaatattaactgttacgacgtaaaatcgtacctttagttcggaccgtaaccgaagccgtaggcacggttggacgttcggtacg

SEQ ID NO: 330947 - DNA, 588 bp, Homo sapiens
  misc_feature: GZ8MTXP02HJN4A.4.9.A09.1.454.CMB.2.raw
  modified_base (279)..(279): a, c, t, g, unknown or other
  misc_feature (279)..(279): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtggtcgttttctaggtggctattttaaaaggtgtcagtgtgaggtgcagttggtggagtcgtgggggagcttggtacagccgtgggggtcctgagactctcctgtacagactctggattcacctttagcagccatcncatgagcgtcggtccgccgcgcgcgagggaggcggtggaggtggtcgtacgagacgtaagtaggtaggtaggtggtggtggtagtacgtactacgtacgacgtacgtacgtacggacgggacgtacgtacactactactacgacgaacgaacgtaactaacgtaaacgtaaacgtaacgttaatactactacgaactaaataacgaacacgcgacgacgacgaccgacgacgacgacgtactactacgtacgtagagtaacgtactactacgtacgacgacgaacgacgacgacgagtcgtcgtcgtcg

SEQ ID NO: 330948 - DNA, 618 bp, Homo sapiens
  misc_feature: GZ8MTXP02F4H97.4.9.A09.1.454.CMB.2.raw
  modified_base (517)..(517): a, c, t, g, unknown or other
  misc_feature (517)..(517): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtggtctttttcttgtggctaattttaaaaggtgtccagtgtgaggtgcagttggtggagtcgtgggggaggcttggtacagccgtgggggtccctgagactctcctgtacagactctggattcacctttagcagccatgccatgagctgggtccgccaggctccgaggggaagggctggagtgggtctcgagctaaagttaggtggagggtggtcgggtggttgggtaactacttaacgtaccggaccaaccgtcccgggtagggacgggggccctatttaccgacctaacttcccgtcccgaaaggtaacgaacctaaatttacccaaaagtaaactaaccgtttaatatacttagaactaaaagtcgaaaacncgccctagaccgacgccgaacgtacgacggtcctaatattactgtagacaaatcgacctttagtcgacgaccgtaagacgacgcgaggtcggcgtggtacg

SEQ ID NO: 330949 - DNA, 569 bp, Homo sapiens
  misc_feature: GZ8MTXP02I6H0P.4.9.A09.1.454.CMB.2.raw
  modified_base (295)..(295): a, c, t, g, unknown or other
  misc_feature (295)..(295): n is a, c, g, or t
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagagcactgtagcacgaccggtgctcgatttagcgagacgcgcagggggagagaggagcccagccctgggattttcaagtgttttcatttggtgatcaggactgaacagagagaactcaccatggagtttgggctgagcgtggtcttttctgtggctattttaaaaggtgtccagtgtgaggtgcagttggtggagtcgtgggggaggcttggtacagccgtggggggtccctgagactctcctgtacagactctggattcacctttagcagccatgccatgagctgggtccnccgaggcctccgagggaagggctggagtgggtctcgagactaagttagngggaggttggtgggtggtggtacagtacgtacggactaacgtccggtaggacggggcccgtattaccaccattccaccgaaggaanactaaattaccaaagtactaacgttatatctaanataatcgacngccgagacgacgccgacgacgacgtactatacgtcgtagtagactagtctacttacgtcgacggacgaaggtcgacgcgtaggtcgtcggttgcg

SEQ ID NO: 330950 - DNA, 634 bp, Homo sapiens
  misc_feature: GZ8MTXP02GJUPL.4.9.A09.1.454.CMB.2.raw
  modified_base (297)..(297): a, c, t, g, unknown or other
  misc_feature (297)..(297): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtcgtgggggaggcttggtacagccgtgggggtccctgagactctcctgtacagactctggattcacctttagcagccatgccatgagcgtcgggtcccnccgaggcctaccggaggggaacggggctgggaggtggggtctcgagacgtaaagttggtggtagggtgggtgggtgggtagtacagttactacgactaaccgtccgagggacggggcctagttccactactcctaccgaagacgaactaattaccgaaagaactacgttaatacgtctacgaactaaagtacgaaacacgaccgtacggacgaaccgacccggaacgaaccggaaccgggtacctaattaacgtttaaccgtgtacgacggtaaaactcggtaaccctttagtacggaccgtaccgaaggtcgtaacgcgtagtcggacgtggtacg

SEQ ID NO: 330951 - DNA, 605 bp, Homo sapiens
  misc_feature: GZ8MTXP02JRJ0F.4.9.A09.1.454.CMB.2.raw
  modified_base (298)..(298): a, c, t, g, unknown or other
  misc_feature (298)..(298): n is a, c, g, or t
  modified_base (574)..(574): a, c, t, g, unknown or other
  misc_feature (574)..(574): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttggtggagtcgtgggggaggcttggtacagccgtgggggtccctgagactctcctgtacagactctggattcacctttagcagccatgccatgagcgtgggtccnccgaggcctccggaggggaaggggctggagtgggtctcgagcaagttaggtggaggtggtcggtggtggtacatacgtacgactaacgtccggtaggacgggggcctagttccaaccgtattcccaccaaggaacgaactaaacttacccgaaaagtaacctaacgtttaataactctagaaactaaatcgaactagcccgtagacgagaccgacgacgacggccttatattacgtgtacgactaaattcgtacctttaagtcgaccgaaaccggngtacgtacgacgtaggtcgtcggtaggtacg

SEQ ID NO: 330952 - DNA, 653 bp, Homo sapiens
  misc_feature: GZ8MTXP02JTHH0.4.9.A09.1.454.CMB.2.raw
  modified_base (536)..(536): a, c, t, g, unknown or other
  misc_feature (536)..(536): n is a, c, g, or t
tcagagcactgtagcacgaccggtgctcgatttagcgagacgcgcagggggagagaggagcccagccctgggattttcaagtgttttcatttggtgatcaggactgaacagagagaactcaccatggagtttgggctgagcgtggtcttttcttggtggctattttaaaaggtgtcagtgtgaggtgcagttggtggagtcgtgggggaggcttggtacagccgtggggggtccctggagactctcctgtacagactctggtattctactttagcagccatcgcctagtgacgcgtcggggtccgccgacggccgtccggaagggggaacggggtcgtagggaggtggggtcctagacgtactaaagtttagggtggggtaaggggttgggttcggggtaggttgggtaacattaccgtaacgacctaacgttccgggtagggacgggggcctagttcccaccgtattccctaccgagaacgaactaacttacccaaagtaacctaacgttatatcctagaactaaatagaaaccncgtacgcggacgacggaccgaacgaccggacgtacttaacgtacgttacgtcggtacacgtaactcgtaccgttagtaccggacgacggcgtacgcgacggtgtcggtacgtacgcg

SEQ ID NO: 330953 - DNA, 526 bp, Homo sapiens
  misc_feature: GZ8MTXP02FIHLX.4.9.A09.1.454.CMB.2.raw
  modified_base (342)..(342): a, c, t, g, unknown or other
  misc_feature (342)..(342): n is a, c, g, or t
  modified_base (432)..(432): a, c, t, g, unknown or other
  misc_feature (432)..(432): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaaggtgtccagtgtgaggtgcagttggtggagtctggggaggcttggtacagcctggggggtccctgagactctcctgtacagactctggattcacctttagcagccatgccatgagctggggtccgccagggctccaggggaaggggctggagtggggtctcgagcaaattagnggaggtggtgggtggtggacgatactacgcaacctccgtagaggggccgattcaccatcctccagagaacaattccaaagaacacgttanatctgacaaatgaacagcctgcgagccgaacgctaaccggccatagtactgtgcgaaaatgccttatcgcaccgaagcgtagcgngngcgngng

SEQ ID NO: 330954 - DNA, 619 bp, Homo sapiens
  misc_feature: GZ8MTXP02FTI8D.4.9.A09.1.454.CMB.2.raw
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagcgtgtcgttttctaggtggctaattttaaaggtgtccagtgtgaggtgcagttggtggagtcgtgggggaggcttggtacaggccgtgggggtccctgagactctcctgtacagactctggtattcacctttagcagccatgccatgagctgggtcccncgaggcctccgaaggggaggggctgggagtggggtctcgagctaaagtttagngggaggtgggtgggttggtggtaacagttaacaccggactaacgtccggtagggacggggccctattaccacctatcctaccgaagacgactaaattacccaaagaactacgttatacttcagacaaatagaacacgaccgtacgacgacgaccgaaccgaccgaaccggtaccgtactattacgtacgtagaccgtaagtacgtacttacgttacgtacgaccggaacgtaccggtaacgtacggtacggtcggtcgtacggtacg

SEQ ID NO: 330955 - DNA, 668 bp, Homo sapiens
  misc_feature: GZ8MTXP02I82O4.4.9.A09.1.454.CMB.2.raw
  modified_base (251)..(251): a, c, t, g, unknown or other
  misc_feature (251)..(251): n is a, c, g, or t
  modified_base (296)..(296): a, c, t, g, unknown or other
  misc_feature (296)..(296): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtcgtgggggaggcttggtacagccgtggggggtccctgagactctcctgtacngactctggattcacctttagcagccatgccatgagcgtgggtccnccaggctccgagggaaggggctggagtgggtctcgagcaaagttaggtggaggttggtgggtgggtggtacagttaccgtacgacctaacgtcccggtagggacgggggtcccgtattaccaccctaagttccctacccgaaaggacgaaactaaactttaccccgaaaagaaacctaacggtttaataacttacctagaaacaaaattacggaaaccgagtccctaggaccgacgacccgacggaacgaccggacccgttaataacgttaccgtaggtcgaaaccgtaaaagttcggtacctttaacgttcggaccggtaaaccggaacgttacggaaacgccgtaaaggttcgggccgttagggttaccg

SEQ ID NO: 330956 - DNA, 738 bp, Homo sapiens
  misc_feature: GZ8MTXP02FRE65.4.9.A09.1.454.CMB.2.raw
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggtctttttcttgtggctattttaaaaggtgtccagtgtgaggtgcagttggtggagtcgtgggggaggcttggtacagccgtgggggtccctgagactctcctgtacagactctggattcacctttagcagccatcgccatgacgcgtgggtcccgccgaggcctccggaggggaggggtcgtggggacggtgggtctcgagtacgtaaagtttacggtgggtaggggtgggtgggttgggtacggtaacgtagttacgtaccgacgtaaccgtccggtaggggacgggggccctacttccgaacctacttccctaccgaggaacgaaactaaacttaacccgaaaagtaaccttaacgtttaatatacgtacgaaacgtaaaatacggaaacacggtacccgtaggaccggaaccggacccggaaccggaacccggtaaccgggtaccccggttaaatttaacccgtttaacgtacggttaacggtaacggtaaaacgttccggttaacccgtttacggttacggaccccggaaccgggaaccggtcggtaaacggtcgggtaaccggtttcgggaccggtttaggggtaaccg

SEQ ID NO: 330957 - DNA, 666 bp, Homo sapiens
  misc_feature: GZ8MTXP02GAGG7.4.9.A09.1.454.CMB.2.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (507)..(507): a, c, t, g, unknown or other
  misc_feature (507)..(507): n is a, c, g, or t
  modified_base (653)..(653): a, c, t, g, unknown or other
  misc_feature (653)..(653): n is a, c, g, or t
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttggtggagtcgtgggggagtcttggtacaggccgtgggggtccctgagtactctcctgtacagactctggtacttccactttagcagccatcgccatgagtcgtcgggtcccncgaggctccggaaggggacggggtctaggacggtggggtctacgagtcgtaaagttaggnggggtagggttggtggggtggtagtaactactacgtaccgacgtaaccgtccggtagggacgggggaccctattaccgaacctatccctacgaagtaacgtaacctaaacgttaacccgaaaagtaaccttaacgtttaanacttaccgtagtaaacctaaagttacgaaaactccgtaccgtacgggaccgaaccggaccgtaaccgaacggtaccggtaccgttaaagtttacctagtagtacggaactaaacgtcgtacttacgtcgacgtacgaagtcagacnggtagcgtagacg

SEQ ID NO: 330958 - DNA, 639 bp, Homo sapiens
  misc_feature: GZ8MTXP02IYEQ7.4.9.A09.1.454.CMB.2.raw
tcagagcactgtagcacgaccggtgctcgatttagcgagacgcgcagggggagagaggagcccagccctgggattttcaggtgttttcatttggtgatcaggactgaacagagagaactcaccatggagtttgggctgagctggcttttcttgtggctattttaaaaggtgtccagtgtgaggtgcagttggtggagtcgtgggggaggcttgggtacaggccgtgggggtccctgagactctcctgtacagactctggattcacctttagcagccatcgccatgagcgtcgggtccgccaggctccggaggggaggggcgtggagtgggtctacgagcaagttaggtggaggggtggtgggtgggtaggtacatacgtacgacgtacgtccggtaggacggggccgaacttccaccgactactccaagaacgacgtaaactttacccaaagtaaaccgaacgtttagtaacttactacgtacgaaattaacggaactaacgcccgtgacccggacgccggacgaccgaaccggtaccggtactacgttagtacgttaggacctaaacgtacgtacgtttactcggacccgtacggaacggtaccggtacggacggtacggtcggtacggtcgggtacg

SEQ ID NO: 330959 - DNA, 539 bp, Homo sapiens
  misc_feature: GZ8MTXP01EC270.44.57.F02.1.454.CMB.2.raw
  modified_base (366)..(366): a, c, t, g, unknown or other
  misc_feature (366)..(366): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctccccagatgggtcctgtcccaggtgcagctgcaggagtcggggccccaggactggtgaggcctttcggggaaccctgtctctcatctgcactgtctctggagttttccatcagttctgatcattcttggggctggatcggcagcccccagggaggggaatggagtggattggtgacatccattatactgggggcgacgtactactctccgtccccctcaagagtcgtctcaccntttcgagggacacgtccatgaaaccgcttctccctgaaactgaccctccgtgaccgccgcggacacggccgtttatttcgtgttgccgaggcgagactggtctttcaatctatggggcctggcacccttggtcacttgttcttcctcagcttcaccaagggcccaagtcccgg

SEQ ID NO: 330960 - DNA, 535 bp, Homo sapiens
  misc_feature: GZ8MTXP01ENPJR.44.57.F02.1.454.CMB.2.raw
  modified_base (365)..(365): a, c, t, g, unknown or other
  misc_feature (365)..(365): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttggggctggatccggcagcccccgagggaggggaatggagtggattggtgacatccattatacgtgggggcgacgtactactctccgtccccctcaagagtcgtctcacctntttcgagggacacgtccatcgaaccgcttctccctgaaactgacctccgtgaccgccgcgacacggcgtttattcgtgtgcgaggcgagacgtggtctttcaatctagtggggctggcacccgttggcacttgttcttcctcagtcttccacaacgggtcccaagtcccg

SEQ ID NO: 330961 - DNA, 547 bp, Homo sapiens
  misc_feature: GZ8MTXP01DPLZH.44.57.F02.1.454.CMB.2.raw
  modified_base (364)..(364): a, c, t, g, unknown or other
  misc_feature (364)..(364): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcagggagtcgggccccaggactggtgaggccttcgggaaccctgtctctcatctgcactgtctctggagtttccatcagttctgatcattcttggggctggatccggcagcccccagggaggggaatggagtggattggtgacatccattatacgtgggggcgacgtactactctccgtcccctcaagagtcgtcctcaccntttcgagggacacgtccatcgaaccgcttctccctgaaactgacctccgtcgaccgccgcggacacggtccgtttactttcgtagtgtcgaggcgagactgggtctttctaatctatggggcctggccacccgttggtcacttgttcttccgtcagtccttcaccgagggcccaagttcccgg

SEQ ID NO: 330962 - DNA, 581 bp, Homo sapiens
  misc_feature: GZ8MTXP01AW6SR.44.57.F02.1.454.CMB.2.raw
  modified_base (367)..(367): a, c, t, g, unknown or other
  misc_feature (367)..(367): n is a, c, g, or t
  modified_base (480)..(480): a, c, t, g, unknown or other
  misc_feature (480)..(480): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatgggagtggagttggtgacatccattatactgggggcgacgtactactctccgtcccctcaagagtcgtctacacctntttcgagggacacgtccatcgaaccgcttctccctgaaacctgaccctccgtcgaccgccgcggacacgggtccgtttattcgtgtcggccgaggcgagacgtggtacctttnaattcgtacgtgggggccgttggcctacccgttggtccacgttcgttccttacccgttcacgtccttacccaccgttacggggccccttaagttccccggg

SEQ ID NO: 330963 - DNA, 569 bp, Homo sapiens
  misc_feature: GZ8MTXP01DR1XT.44.57.F02.1.454.CMB.2.raw
  modified_base (370)..(370): a, c, t, g, unknown or other
  misc_feature (370)..(370): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccccgaggggacggggaagtggaggtggagttggtgacatccattatacgtggggcgacgtactactctccgtccccctcaagacgtcgtctacaccntttcgagggacacgtccatcgaaccgcttctccctagaaactgacctacgtgaccgccgcgacacggccgtttattcgtgtggcgacggtcgagtactcggttactttcaattcgtagtgggggccttgggctacccgttggtcacgttgttccttccgtcagtccctttccaccgttaacgggccccaagtttcccgg

SEQ ID NO: 330964 - DNA, 644 bp, Homo sapiens
  misc_feature: GZ8MTXP01AKOGR.44.57.F02.1.454.CMB.2.raw
tcagacagtatatacacgaccggtgctcgatttagctcgatatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtcccccaggacacacagtcactattacctgctcgtaggggaaaacttgagtgataaatttgcttcctggtatcagcagaggccaggccacgccccctatgctggtcatctttacaggataagtaacgccggccctcgagggactcccgtgagcgtcttcctctggcctacccaacgtcgtacgggaaccaccgggcccactctcgaaccactaccacgccgaccgaccccgagccctacgtggacttcggacggccttacgtacttattacgtgggtacgaaggtaccggtaggggtaaacgttggtacgttaaaggtttgggggtacgtttccggggaccggggaacgggtacccgaaaggtccgttggacccgtttcgtccggtacaccggcccgaacgggtcccgtccggtccccccgtagggtcccacgtttcccgttccgtttaacccccc

SEQ ID NO: 330965 - DNA, 647 bp, Homo sapiens
  misc_feature: GZ8MTXP01DS4IX.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggactccggcacggcccccgaggggaggggaatgggattggagttggtgacatccattagtacgtggggcgacgtactactctccgtcccctcaagcgtcgtctccactgtttcgagggaccacgtccatcgaacccgtcttctccctagaaactcgaaccctcgtcgaccgccgacggaccacggtcctttacgtttcgtgttcgacggacgggcgacggtaccgttggttaccttttcgtaaacgttccgtaacgggttcggggggtcccgttcgggttcccgtaacccgttcgggttaccctcgtttccggttccttacccttcgaacggttccctttacccgaacccggttaaacggggtccccttaacggttttcccccggg

SEQ ID NO: 330966 - DNA, 651 bp, Homo sapiens
  misc_feature: GZ8MTXP01APR22.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcgacgccccgaggggagggagtggaggtggagttggtgacatacctattagtacgtggggacgtacgtacctactcgtcccgtccccctacaagtacgtccgtctaccacctctttcggacggacacgtcactcgaaccgtccttcctccctagaacctcgaccctccgtcgacccggccgaccggacgtaccggtccgtttagttcgtggtcggacgaggcgagtacgttcggttactttcgaaacgttcgtaacgggtcgggggtaacccgtggttcccgtaacccgttgggtacctaccgttcgttcccgttacccgttccgtacgtcccgtttaccccgacccgggttaaaccggtccccgttaacgtttcccccggg

SEQ ID NO: 330967 - DNA, 545 bp, Homo sapiens
  misc_feature: GZ8MTXP01A59MI.44.57.F02.1.454.CMB.2.raw
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (462)..(462): a, c, t, g, unknown or other
  misc_feature (462)..(462): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgtgggctggatccggcacgcccccgagggagggaagtggagtggagttggtgacatcattatacgtgggcgacgtactactctccgtccccctacagtacgtcgtctacaccngtttcgagggacacgtcatgaaccncttcncctagaaactgacctcgtcgaccgcgcgacgcgcgtttattcgtgtcgcgaggcgagcgtggtcttnaatcgtagtgggccgtggctaccgttggtctacttgttcttcctcacgtccttcccaccgttaacgggccccaagttccccgg

SEQ ID NO: 330968 - DNA, 695 bp, Homo sapiens
  misc_feature: GZ8MTXP01BVG2R.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacggcccccgaaggggaggggaacgtgggagtgggagttggtgactatacctattatacgtggggcgtacgtactacgtctccgtcccctcaagacgtcgtctaccacctgtttcgagggacacgtcatcgaacccgtcttctccctagaaactcgacccttacccggtcgaacccgcccgtcggaccgtacggtccgttttacgttccggtggttcggaccggtagggccgtaacgggtacttcggggttaccttttacgtaaacgttccgttaacgggtccggggggtcccgttccgggttccgttaaccccggttgggttcccgtaacgtttcggttccccttcccgttaaccgtaccggtaacccctttaccccgaaacccgttaaccgggggtaacccccttaacggtttccccccgggg

SEQ ID NO: 330969 - DNA, 591 bp, Homo sapiens
  misc_feature: GZ8MTXP01EKRXC.44.57.F02.1.454.CMB.2.raw
  modified_base (373)..(373): a, c, t, g, unknown or other
  misc_feature (373)..(373): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacgcccccgaggggaggggaagtgggagtggagttggtgacatccattagtacgtgggcgacgtactactctccgtcccctcaagtacgtcgtctacacctntttcgacgggacacgtccatcgaaacccgtcttctccctagaaacctcgaaccctccgtcgaccgccgcgaccacggtccgtttattcgtgtgtcgaggcgagtacgttggtactttcgtaattcgtaggtcggggccgttggcctacccgttggtcctacgttcgttccttccttcagtccttacccgaccgaacgggtccccttaagtttccccgg

SEQ ID NO: 330970 - DNA, 592 bp, Homo sapiens
  misc_feature: GZ8MTXP01D7ZTW.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacgcccccgaggggacggggaagtggagtggagttggtgacatctattagtacgtgggcgtacgtactactctccgtccccctcaagacgtcgtctacacctcgttcgaacgggaccacgtccaatcgaacccgtcttctccctagaaactcgaccctccgtcgaccgccgcgaccgcggtactttattcgtgtgcgaggtcgacgacgttggttactttcaaagttcgtaggtcggggccgtcggcctacccgttgggtccacgtttcgccttccgttcacggtcccttaccgacccgaacgggtccccaagtttccccgg

SEQ ID NO: 330971 - DNA, 796 bp, Homo sapiens
  misc_feature: GZ8MTXP01AHESU.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgctactgtctctggtattcatctagttctgatctattcgtgggctggactccggcacgccgacggagggagggaatggagtggtattggtagaactacgttcctaagtttaacgtacggtacgggggacctaaccggtaccttaccgtcccgttaccccccggttacccctacgtaaacggtacgttccgtaacccttaccaacccgttaggtttacccgggaacgggtaccctaccggtaccaagttacccggaaacccgttcctttaccctacccgtaagtaaacccttcggtaaccccttccgggtacgaaccccggcccggacccggtaaccgtacccggggttttacccgtttttaacggtttcggtacgggtaccggtaacggggtacgggtaccggtaacggttaccgtttacggggtttacctttacggtaaacgtttccggttaaggggtccgggggtacccgttcggggaccccttaccggggttcgttaccttaccgtttcgttaccccgttccctcgtaaccggtcccttaccccggaacccggtaaccgggttcccccgttaaccggg

SEQ ID NO: 330972 - DNA, 673 bp, Homo sapiens
  misc_feature: GZ8MTXP01DCPLM.44.57.F02.1.454.CMB.2.raw
  modified_base (355)..(355): a, c, t, g, unknown or other
  misc_feature (355)..(355): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcagcccccgagggacggggaagtggagtggagttggtgacagtccattatacgtggggcgacggtactactctccgtcccctcaagngtcgtctaccacctgtttcgagggacaccggtccatacgaacccgctttccgtaccctagaaactcgtaacccgtccgtcgaacccgcccgaccggaaccgaccgggtacccgttttaactttcggtcggttggaccggacggtcgacggtacgttcgggtttacctttcgtaaagttccttaacgggtcgggggtcccggttcgggcccgtaccccgttgggttacccgcgtttcggttcccttccccggttcctaacgggtccctttaccccgaacccggttaaacggggtcccccttaacggttttccccccggg

SEQ ID NO: 330973 - DNA, 578 bp, Homo sapiens
  misc_feature: GZ8MTXP01BH8JB.44.57.F02.1.454.CMB.2.raw
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (528)..(528): a, c, t, g, unknown or other
  misc_feature (528)..(528): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacggcccccgagggacggggagtggagtggagttggtgacatccattagtacgtggggcgtacgtacctactccttccgtccccctacgaagtcgtcgtctaccacctgtttcgagggacacgtccatcgaaccgtcttctcccgtagaaactcgaaccctccgtcgacccgccgcgaccncggtcctttattcgngttgcgaggcgtagacgtggttctttcaattctagtggggccgtggctacccgttggtaccncttcgttccttcgtcagcccttaccaccgacggtcccttaagttccccgg

SEQ ID NO: 330974 - DNA, 665 bp, Homo sapiens
  misc_feature: GZ8MTXP01DC5G2.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtattccatcagttctgatcattcgttggggcttggatccggcacggacccccgaggggacggggaatgggagtggagttggtgacgataccattatacgtggggcgacgtactactctccgtccccctcaagagtcgtctaccactgtttcggacgggaccacgtcccatacgaacccgtcttctaccctagaaaccttcgaaccctccggttacgaccccggtcccggacggactaccgggtacccgttttacgtttcggttacggttcggacggtaacgggcgtacgtacgttgggttaccttttcgtaaattccgttaagttcgggggcccgttcgggccctaccccgttgggttacctcgttcggttcccttcccctcgtacgtcccgtttccccgaaccgttaaccgggggtccccttaacggtttccccggg

SEQ ID NO: 330975 - DNA, 691 bp, Homo sapiens
  misc_feature: GZ8MTXP01DK78M.44.57.F02.1.454.CMB.2.raw
tcagacagtatatacacgaccggtgctcgatttagctcgatatagttgggtttgggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggacctgtctctcatctgcactgtctctggtacgtttcatcagttctgtatctagttcgttggggctggatccggcacgccccgaggggacggggaagtgggagtggagttggtagacatctattagtacgtggggcgtacgttactactctccgtcccctacaagacgtcgtctaccacctgtttcgacgggactaccgtaccagtacgaacccgtcttcctaccctagtaaacctcgtaacccgtccgtcgaccgcccggcggacctacgggtccgtttacgtttcggtacggttcggcggacgggtacgtacggtccgttcgggttcctttacgtaacgtttcgtaacgggttcgggggtccgtcgggttacccgttaaccccgttcggggttaccctaacgtttcggttcccgttcccgttccgtaaccgttccctttaccccgaacccgggttaaaccggggtcccccttaacggttttcccccccgggg

SEQ ID NO: 330976 - DNA, 634 bp, Homo sapiens
  misc_feature: GZ8MTXP01C35U7.44.57.F02.1.454.CMB.2.raw
  modified_base (159)..(159): a, c, t, g, unknown or other
  misc_feature (159)..(159): n is a, c, g, or t
tcagacagtatatacacgaccggtgctcgatttagctcgatatagttgggtttggggctgaggtgaagaagcctggggcctcagtgaaggtttactgcaaggcttctggatacaccttcaatatttatgctatgcagtgggtgcgccaggcccccgganaaaggcttgagtggatgggatggatcaacgctggcaatggtgacacaagatattcacagaagttccagggcagagtcaccattaccagcgacacatccgcgagcacagcctacatggagctgagcagcctgagaatctagaagactacggactagtatattatgtgcgaaggaggaaaggggggaatacgaactaacgggtaaactacctacttaataactacttaacatagggtacgtcgtacgggggacgaaagggtacccaaagtcgggttcaaacccggttctaccctcaacgcccttaccgaacccgaaacggggccccaaagttcccgggtccctttcccccccggtcgggtccccgccccgtcgtcccgtaccgacggaacgtaccgacccgtacccggaccgaccggacgaaccgccggcccggcccggtcggtccgtcggtccgttacggtaacgttaacgtaacg

SEQ ID NO: 330977 - DNA, 529 bp, Homo sapiens
  misc_feature: GZ8MTXP02HE9MT.44.57.F02.1.454.CMB.2.raw
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (439)..(439): a, c, t, g, unknown or other
  misc_feature (439)..(439): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggaggggatggagtggattggtgacatccattatactggggcgacgtactactctccgtccccctcaagagtcgtctcaccntttcgagggacacgtccatcgaaccgcttcnccctgaaactgaccctcgtcgaccgccgcgacacggccgtttattccngttgcgaggcgagactggtcttcaatctagtggggcctggcaccctggtcacgtcgtctcctcacgcttccaccacggccctagtcccgg

SEQ ID NO: 330978 - DNA, 533 bp, Homo sapiens
  misc_feature: GZ8MTXP02HNUCE.44.57.F02.1.454.CMB.2.raw
  modified_base (363)..(363): a, c, t, g, unknown or other
  misc_feature (363)..(363): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggagttggtgacatccattatactggggcgacgtactactctccgtccccctcaagagtcgtctcaccntttcgaggacacgtccatgaacccgcttctccctgaaactgaccctccgtgacccgccgcggacacggtccgtttatttctgttgcgaggcgagactggtctttcaattctagtcggggcgtggcacccgtggtcactcgtctctcacgcttccacacggcccagtcccg

SEQ ID NO: 330979 - DNA, 564 bp, Homo sapiens
  misc_feature: GZ8MTXP02HZ7FR.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaagtggagtggagttggtgacatccattatactggggcgacgtactactctccgtcccctcaagagtcgtctcaccatttcgagggaccacgtccatcgaacccgcttctccctgaaacctgacccttccgtcgaccgccgcggacacggccgttttattctgttgcgaggcgagactggttctttcaattcgtaagtcgggggccgttggcctacccgtgggttccacgttcgtcctcctcgagtccttccaccgaacgggtcccagtttcccgg

SEQ ID NO: 330980 - DNA, 557 bp, Homo sapiens
  misc_feature: GZ8MTXP02H85IA.44.57.F02.1.454.CMB.2.raw
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (449)..(449): a, c, t, g, unknown or other
  misc_feature (449)..(449): n is a, c, g, or t
  modified_base (513)..(513): a, c, t, g, unknown or other
  misc_feature (513)..(513): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccccgagggacggggaatggaggtggagttggtgacatcctaattatacgtggggcgacgtactactctccgtccccctcaagagtcgtctcaccntttcgaggacacgtccatgaaccgcttcnccctagaaactgaccctccgtgaccgccgcggacacggtccgtttatttccngtgcgaggcgaggacctggtcttcgaatctagtggggcctgggccacccgtggcacgtcgttcncctcacgccttacccgaaccgaacgggcccctaacgttccccgg

SEQ ID NO: 330981 - DNA, 660 bp, Homo sapiens
  misc_feature: GZ8MTXP02I0I62.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgcccccgaggggaggggatggaggtggagttggtgacatcctattatacgtggggcacgtactactctccgtcccctacaagtacgtcgtctccgacctgtttcggacggggtacaccgtccagtcgaaacccgtcctttcctccctagaaacctcgaacccttccgtcggacccgcccggaccggaccgtaccgggttcccgttttaacttttcgtcggttcggacggtacgggaccgaaagtccgttcgggttccttttacgaaacgttccgtaagtcgggggtaccggttcggaccctaccccggttgggtacctacgttcggttcccttccgtcgtaccgtcctttacccgaaccgttaaccggggccctaacgtttcccccggg

SEQ ID NO: 330982 - DNA, 570 bp, Homo sapiens
  misc_feature: GZ8MTXP02FXBOT.44.57.F02.1.454.CMB.2.raw
  modified_base (366)..(366): a, c, t, g, unknown or other
  misc_feature (366)..(366): n is a, c, g, or t
tcagacagtatatacacgaccggtgctcgatttagctcgatatagttgggtttgggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgcccccgaggggacggggaatggagtggagttggtgacatccattatacgtggggcgacgtactactctccgtcccctcagagtcgtctcaccntttcgagggacacgtccatcgaaccgtcttctccctgaaactcgaccctccgtcgaccgccgacgacacggtccgtttattcgtgtcgcgtagggcgagacttggtctttcaatctagcggggtccgtggcctacccgtggtaccacgttcgtccgttcctcgacggtcccttaccacccgtaacgggccccagtttccccggg

SEQ ID NO: 330983 - DNA, 571 bp, Homo sapiens
  misc_feature: GZ8MTXP02G8U4V.44.57.F02.1.454.CMB.2.raw
  modified_base (367)..(367): a, c, t, g, unknown or other
  misc_feature (367)..(367): n is a, c, g, or t
  modified_base (530)..(530): a, c, t, g, unknown or other
  misc_feature (530)..(530): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggacggggaatggagtggagttggtgacatccattatacgtggggacgacgtactactctccgtccccctcaagacgtcgtctcactntttcgaggacacgtccatcgaaacccgtcttcctccctagaaacctcgaccctccgtcgacccgccgacggacacggtccgtttaatttcgtgtgcgaggcgagactggtctttacaatcgtagtcggggtccgtggccacccgtggtccacgtcgtcctccncgtacgtccttaccgaccgaacgggtcccacgtttccccgg

SEQ ID NO: 330984 - DNA, 610 bp, Homo sapiens
  misc_feature: GZ8MTXP02IBUM8.44.57.F02.1.454.CMB.2.raw
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
tcagacagtatatacacgaccggtgctcgatttagctcgatatagttgggtttgggatgctttctgagagccaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcttggggctggatccggcacgcccccgaggggacggggaatgggagtggagttggtgacatccattatacgtggggcgacgtactactctccgtccccctcaagtacgtcgtctcaccctntttcgaggaccacgtccatgaacccgcttcnccctgaaactgaccctcgtcgacccgccgcggacacggtccgtttatttccgtgttgcgtaggcgagtactgggttctttacgaatcgttaagtcgggggtccgtcgggtcctaaccccgttgggtcctacgttcggttcccttcccgtccgtacggtccctttacccgaacccggtaacggggtccccctaacgtttccccccggg

SEQ ID NO: 330985 - DNA, 603 bp, Homo sapiens
  misc_feature: GZ8MTXP02HLHJK.44.57.F02.1.454.CMB.2.raw
  modified_base (371)..(371): a, c, t, g, unknown or other
  misc_feature (371)..(371): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggaggggaagtggagtggagttggtgacatccattatacgtggggcgacgtactactcctccgtcccctacaagtacgtcgtctcacctntttcgaggacacgtccagtcgaaaccgcttcctccctagaaacctcgaccctccgtcgacccgccgaccgacgacggtccgtttatttcgtgtgcgacgggcgagacgtggttctttacgaaattcgtagtcggggtccgtcgggcctacccgtgggtaccctacgtccgttcctcccttaacgacggtcccttacccgaacccgtaaacgggcccctaacgtttcccccgg

SEQ ID NO: 330986 - DNA, 618 bp, Homo sapiens
  misc_feature: GZ8MTXP02F3SNY.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggatccggcacgccccgagggagggagtggagtggagttggtgacatcctattagtacgtggggcgtaacggtactacctccttccgtccccctacaagtacgtccgtctccacctgtttcggaacgggaccacgtccagtcgaaacccgtctttcctccctagaaaacctcgaaccctccgtcgacccgccgtcgaccacggtccgtttattcgtgtgccgaggacgacgtacgttggttctttacgaattcgttacggtcgggggtccgtcggccgttaccccgtggtaccttcgttcgtccttcccgtcgtaccgtccttacccgaaccgaaccgggtccctacgtttccccgg

SEQ ID NO: 330987 - DNA, 569 bp, Homo sapiens
  misc_feature: GZ8MTXP02FKNTJ.44.57.F02.1.454.CMB.2.raw
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgagggaggggaagtggagtggagttggtgactatccattagtacgtggggcgacgtactactcctccgtcccccctacaagacgtcgtctcacctgtttcgaggacacgtccatacgaccctcttctccctagaaactgaccctccgngacccgccgcgacncggtcctttattctgngcgaggcgacgacgttgtctttcaatcgtagtcggggccgtgggcctacccgtggtccacgttcgtcctccgtcgacgtccttacccgaccgaacgggtcccacgttcccgg

SEQ ID NO: 330988 - DNA, 644 bp, Homo sapiens
  misc_feature: GZ8MTXP02JG66Q.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaagtggaggtggagttggtgacatccattatacgtggggcgacgtactactctccgtccccctacaagacgtcgtctcacctgtttcgaggtacacgtccagtacgaaccgtcttcctaccctagaaactcgacccgtccgtcgacccgccgcggaccaccggtccgtttactttctcgtcgtcggtacggccggtaagtacgttgggttcctttacgtaaacgttccgtaaggtccgggggtcccggtgggtacccgtaaccccgtgggtcctaaccgtttccggtccttcccgtcgtaaccgtccctttacccggaacccgtaaaccgggggtcccccaacgtttccccccggg

SEQ ID NO: 330989 - DNA, 604 bp, Homo sapiens
  misc_feature: GZ8MTXP02JZVI7.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgagggaggggaagtggaggtggagttggtgacatcctagttacgtacgtggggacgacgtactactctccgtccccctacgaacgtagtccgtctcctacctgtttcgacggacacgtccaatcgacccgtccttcctccctagaaactcgacccgtccgtcgacccgccgcgacgaccggtccgtttacttcgtggtaaacgcggaacggcgagtcgttcggttcttcgattcgtagtcggggtccgtcggcctacccgtgtccgtacgtcgtccttacctcgtacgtccttacccgaccgtaccggcccctacgttccccgg

SEQ ID NO: 330990 - DNA, 585 bp, Homo sapiens
  misc_feature: GZ8MTXP02IT8MD.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggagtggagtggagttggtgacatccattatacgtggggcgacgtactactctccgtcccctcaagagtcgtctccacctagtttcgacggacaccgtccagtcgaacccgtcttctccctagaaactcgacccttccgtcgaccgccgacggacacggtccgtttatttctgtcgcggaggcgaagtcgtggttctttacgaattcgtagtcggggtccgtggccacccgttggtacctacgttcgtcctccgtctacgtccttacccgaacccgtaacgggcccctaagtttccccgg

SEQ ID NO: 330991 - DNA, 555 bp, Homo sapiens
  misc_feature: GZ8MTXP02JWF6B.44.57.F02.1.454.CMB.2.raw
  modified_base (360)..(360): a, c, t, g, unknown or other
  misc_feature (360)..(360): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctccccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggatggagtggattggtgacatccattatacgtggggcgacgtactactctccgtccccctcagagtcgtctcacctntttcgagggacacgtccatcgaaacccgcttctccctgaaacctcgaaccctcgtcgaccgcccgcggaccgacggtcctttattctgttcgcgaggcgagtactcggttctttccgaatccgtagtcggggtccgtggccaccgtggtcacgtcgtctcctcacgtccttccgactacgggcccacgttcccgg

SEQ ID NO: 330992 - DNA, 517 bp, Homo sapiens
  misc_feature: GZ8MTXP02HVHKB.44.57.F02.1.454.CMB.2.raw
  modified_base (321)..(321): a, c, t, g, unknown or other
  misc_feature (321)..(321): n is a, c, g, or t
  modified_base (449)..(449): a, c, t, g, unknown or other
  misc_feature (449)..(449): n is a, c, g, or t
tcagacagtatatacacgaccggtgctcgatttagctcgatatagttgggtttggggctgaggtgaagaagcctggggcctcagtgaaggtttcctgcaaggcttctggatacaccttcaatatttatgctatgcagtgggtgcgccaggcccccggacaaaggcttgagtggatgggatggatcaacgctggcaatggtgacacaagatattcacagaagttccagggcagagtcaccattaccagcgacacatccgcgagcacagcctacatggagctgagcagcctgagatctgaagacacggctgtatatattgtgngagaggaaggggatgactcggtaactactctattactactacatgacgtcgtggggcgaaggggcagtggtcaccgtctccgtcacgccctccaccgaagggccccatccggtcctcccccgtggccnccctgctccaggcgcaccctccgagacgcacacgccggccctgggctcggacctcggtacaaggtacc

SEQ ID NO: 330993 - DNA, 612 bp, Homo sapiens
  misc_feature: GZ8MTXP02H3GIM.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgttggggctggatccggcacgcccccgaggggagggaagtgggagtggagttggtgacatcctattagtacgtggggacgtacgtactacctctccgtcccctacgaacgagtccgtctcacctgtttcgaagggtaccacgtccagtcgaacccgtcttcctccctagaaaacctcgacccttaccggtcgacccggtccgaccggaccgtacggtacccgttttatttccgtggtcgacggagggacgacgtacgtcggtttacttacgaaattcgtaagtcgggggccgtggacctaccgtggtaccacgtcgtcctccgtcgacgtcttacccacgaccgggtcctacgttcccg

SEQ ID NO: 330994 - DNA, 596 bp, Homo sapiens
  misc_feature: GZ8MTXP02ISYOA.44.57.F02.1.454.CMB.2.raw
  modified_base (308)..(308): a, c, t, g, unknown or other
  misc_feature (308)..(308): n is a, c, g, or t
  modified_base (469)..(469): a, c, t, g, unknown or other
  misc_feature (469)..(469): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgtatctattcgttggggctggactccggcacgcccccgagggagggaagtggagtggagttggngacatcctaattagtacgtggggcgtacgtactacctctccgtcccctacaagacgtcgtctccactgtttcgagggacacgtccagtacgaaccctcttcctaccctagaaacctcgaccctccgtcgacccgcccgacgaccgacggtcctttatttcngttgcgagggcgagacgttcggttacttcgaattcgtagtcggggtccgtggtccctaccgtggtcctacgttcgtccctcctccgtacgtcccttacccgaccgtaaccgggccctacgttcccgg

SEQ ID NO: 330995 - DNA, 890 bp, Homo sapiens
  misc_feature: GZ8MTXP02JPB7V.44.57.F02.1.454.CMB.2.raw
tcagacagtatatacacgaccggtgctcgatttagctcgatatagttgggtttgggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccgttcgggaaccctgtctctcatctgcactgtctcgtggtagtttccatcagttctgtatctattcgttggggctggacgtccggcacggcccccgaggggacggggaagtggaggtggtagttggtgacgatcctattactacgtggggacgtaaccgtactactccgtcccgttcccctacctaacgtacgtccgttctaccgtacctacgttttaccggaacgggggtaaccctaccgttaccctaacgttaccggtaaaacccccggtccttttacccctacccccgttaaacggtaaaaacccgtttcccgggtaaaccccctttcccggggttacccggtaacccccggggtacccccggggacccgggggtaaacccccggttaacccgggggtttacccccggttttttaaacgttttacccgttacgggggttccgggttaccgggaaaccgggggtccgggtaaaacggtacccggtttccgggggtttacctttttaaccgaaaacgtttccccggttaaggggttcccggggggtacccggggttacgggtccccgtaaacccccgggttaggggtttaccctacccgttccggtttcccgtaacccccgttcgtacccggtaccccttttacccccggaaaaccccgtaacccgggggtccccctaacggttttcccccccggggg

SEQ ID NO: 330996 - DNA, 582 bp, Homo sapiens
  misc_feature: GZ8MTXP02ID89F.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcatcctgctggtggcagctcccagatgggtcctgtcccaggtgcagctgcaggagtccgggcccaggactggtgaggccttcgggaaccctgtctctcatctgcactgtctctggatttccatcagttctgatcattcgtgggctggatccggcacgccccgagggaggggaagtggagtggtattggtgacagtccatttatacgtggggctacgtactactctccccgtccctcaacgagtcgtctcacctagtttcgacgggtactaccgtccatcgaacccgtctcctccctgaaacctcgaccctccgtcgacccgccgcgacaccggttccgtttatttcgtgttcgcgtacgggcgaagtcgttggttctttacgaacgtcgtaaggtcggggtcgtcggcctacccgtggtccacgttcgtcctccctcgacgtccttaccgaccgtaacggccctaccgg

SEQ ID NO: 330997 - DNA, 572 bp, Homo sapiens
  misc_feature: GZ8MTXP02JOQZN.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggacggggaatggaggtggagttggtgacatccattatacgtggggcgacgtactacctctccgtccccctcaagagtcgtctcacctgtttcgagggacacgtccagtcgaaaccgtcttcctccctagaaacctgtaaccctcgtcgacccgccgacggaccacggtccgtttatttcgtgttgcgtaggcgagacttggtctttacaagttctagtcggggtccgtggccgtaccgtgggtctacgtcgtcctcctgacgtcttacccacgaacggccctagttccccgg

SEQ ID NO: 330998 - DNA, 548 bp, Homo sapiens
  misc_feature: GZ8MTXP02IC02K.44.57.F02.1.454.CMB.2.raw
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagacagtatatacacgaccggtgctcgatttagctcgatatagttgggttttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatgggagtggagttggtgacatcctattatacgtggggcgacgtactactctccgtcccctcaacgatcgtctccacctgtttcgaagggacacgtccatcgaaccgcttcncctagaactcgaccctcgtgacccgcgcgacacgtccgtttatttcgngttgcgtaggcgagactggttcttcgaatctagtcggggctggccacccgtggctactcgtctccgtcacgtcctccgacgaccggccacgtttcccgg

SEQ ID NO: 330999 - DNA, 627 bp, Homo sapiens
  misc_feature: GZ8MTXP02I5YPW.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgtatctattcgttgggctggatccggcacgcccccgaggggacggggaagtggaggtggagttggtgacgatcctagttacgtacgtggggtacgacgtactactcctccgtcccctcaagtacgtcgtctcactcgtttacgacgggacacgtccagtacgaaccgtccttcctccctagtaaacctcgaccctccgtcgacccgtccgaccgacgtacggttcccgtttatttccgtacgttgaccgggaggacggtacggtacgttagggttcctttacaacgttcgtacgggtcgggggtccgtcggaccctccggttcggtctacgtcgttcctcgtaaccgcgtcttacccgaaccggacggtcctacgttccccgg

SEQ ID NO: 331000 - DNA, 582 bp, Homo sapiens
  misc_feature: GZ8MTXP02GC2RF.44.57.F02.1.454.CMB.2.raw
  modified_base (442)..(442): a, c, t, g, unknown or other
  misc_feature (442)..(442): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgcccccgaggggacggggaagtggagtggagttggtgacatcctattatacgtggggcgtacgtactactctccgtcccctcaagtagtccgtctccacctgtttcgagggacacgtccatcgaaaccgtcttctccctagaaactcgacctccgtcgaccgccgcgacncggtccgtttattctgtgcgaggcgacgacgttggttcttacaagttccgtaggtcggggcgttggcctaccgtggtactacgttcgtccttcctaacgacgtccttacccgaccgaacgggtcccctagtttcccccgg

SEQ ID NO: 331001 - DNA, 588 bp, Homo sapiens
  misc_feature: GZ8MTXP02HQ28G.44.57.F02.1.454.CMB.2.raw
  modified_base (503)..(503): a, c, t, g, unknown or other
  misc_feature (503)..(503): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacggcccccgaggggaacgggaagtgggagtggtagttggtgacgatccattatacgtggggcgtacgtacgtactcctccgtccccctacaacgagtcgtctccactgtttcgaagggacaccgtccatcgaacccgacttctaccctgtaaacctgtacccttccgtcgacccgccgcggacgacgtccgtttatttctgttagcgtagggccgtagccgttggtctttanaacgtctagtcgggggcctgggcctacccgtggtcctacgtcgtctccgtaacgcgccttcccaccgacggtcccacgttcccgg

SEQ ID NO: 331002 - DNA, 560 bp, Homo sapiens
  misc_feature: GZ8MTXP02IZ0PA.44.57.F02.1.454.CMB.2.raw
  modified_base (477)..(477): a, c, t, g, unknown or other
  misc_feature (477)..(477): n is a, c, g, or t
  modified_base (525)..(525): a, c, t, g, unknown or other
  misc_feature (525)..(525): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattgttggggctggatccggcacgcccccgaggggacggggaagtgggaggtggagttggtgacatccattatacgtggggcgtacgtactactctccgtcccctacgaagcgtcgtctctacctgtttcgaggcaccgtccatgaaccgtctctcccagaaactgaccctcgtccgaccgccgacgacacggtctttattcgtgttcgcgagcgaagcgtgttcttanatcgagttcggggcctgggcctaccgtggtactcgtcgtcctccgtcncgtccttaccaccgaacggccctacgtttccccgg

SEQ ID NO: 331003 - DNA, 635 bp, Homo sapiens
  misc_feature: GZ8MTXP02H2Z2A.44.57.F02.1.454.CMB.2.raw
  modified_base (491)..(491): a, c, t, g, unknown or other
  misc_feature (491)..(491): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtactctattcgtggggctggacgtccggacgaccgaccccggaggggagggtagtgggagtggagttggcgactatcctaatttacgtacgtggggtacgtacgtaccgtacctccgttccgtcccctacgaacgtcgtccgtactactacctgttacggacggacctacgtcctagcgaacccgtcttacctccctagaactcgacccgttcgacgaccgccgacgacgacggttaccgtttnttccgtgtgacgaggcgtagtcgttgttctacgtaatcgtaggtcgggtccgtcggaccctccgttcggtacctcgttcgttcctccgtccgtacgttacccgttacccaaccggtaaccggggtcccttaacggttcccccgg

SEQ ID NO: 331004 - DNA, 589 bp, Homo sapiens
  misc_feature: GZ8MTXP02JM49J.44.57.F02.1.454.CMB.2.raw
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagacagtatatacacgaccggtgctcgatttagctcgatatagttgggtttgggatgctttctgagagtcaaggacctcctgtgcaagaacatgaagcacctgtggttttttcctcctgctggtggcagctcccagatgggtcctgtcccaggtgcagctgcaggagtcgggcccaggacgtggtgaggccttcgggaaccctgtctctcatctgcactgtctctggagtttccatcagttctgatcattcttggggctggactccggcacgcccccgagggacggggaatggaggtggagttggtagacgatccaattactaacgtggggtcgacgtactacctcctccgtccccctactaacgacgtcgtctcactnttcggaggacacgtccatgaacccncttcacctacgaaactctacccgtacgtcgaacccgtccgacgaccgtacgtaccgtttattcgtcgtgccgtagggcaagtcttcggtctttacagttctagtcggggtcgtggacctacccgtggcctacgtcctcgtcctcgaacgtccttacccgaacaccggtcccacgtttccccgg

SEQ ID NO: 331005 - DNA, 765 bp, Homo sapiens
  misc_feature: GZ8MTXP02GD2QY.44.57.F02.1.454.CMB.2.raw
tcagacagtatatacacgaccggtgctcgatttagctcgatatagttggggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgatctattcttggggctggatccggcgacgcccccgagggaggggaatgggagtggattggtgacatctattatacgtggggaccgtacgtacgtacctccgtccgtcccccgtacaagtacgtccgtactaccacctacgtttccggaacgggtacctaccgtccctaagtcggtaaacccgtccttccgtacccctagtaaacctcgaaaccccgttacggtaccgaacccggcccgggacgggacccgtacggggttacccgttttacgtttccgtacggttcggaccgggttaggggaccgtaacggtaccgtttacggggtttaccctttaacgaacggtttaccgttaacgggttcccggggggtacccgttacgggggtccccctaaaccccggttcggggttaccctaaccgttccggttacccctttccccgtaaccgtaaccggttcccctttacccccggaaacccggtaaaaccccgggtccccgttaaaccggttttccccccggg

SEQ ID NO: 331006 - DNA, 735 bp, Homo sapiens
  misc_feature: GZ8MTXP02HCKL2.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctattcgttggggctggactccggcacgccccgaggggacgggaagtggagtggagttggtagactataccgtaattacgtacggtcggggacgtaccgttacctacgtcctccgtccccctacaacgtacgtccgttctaccaccgtcgtttccggacgggtaacctacccgtacctacgtacggaaacccgtccttccctaccccgtaggtaaacccttccggtaccccgttaccggtcccggaacccggtcccggacccgtaccgtccggttacccgtttacgtttcgtcggttccgacgggtacgggtacgtacggtaccgttcgggttacctttacgtaaacgttccggttaaggtccgggggttccggttacggtccccgtaacccggttcgggtccttaccgttcgttccccttcccgtaacggtaccttccccgtacccgtacccggtaaccggtaccccttacggtttcccccggg

SEQ ID NO: 331007 - DNA, 708 bp, Homo sapiens
  misc_feature: GZ8MTXP02GB4OT.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtccgggcccaggacgtggtgacggccgttccgggaaccctgtctctcatctgcactgtctcgtggtactttccatctagttctagtatctagtttcgttgggctggacgtccggccgaccggcccccggaaggggaacggggtagtaggaggtaggtagttggtacgaactatccgtaagttagtacggtggggaccgtaacgtacctaccgtccgtcccgtccccctacgaacgtacgtccgttacctaccgtaaccgtacgtttacggaaacggtaccgtaccgtaccacgtaccgaacccgtcctttaccctaccctagtaaacctcgtaacccgttccgaccgacccgccggaccggaccgtaaccggttccgttttaacttccgtgtcggacggacgggtacaacggttccgttggttacctttaacgacttcggtaggtcgggtcgtcggccgttacccgtggtacctacgttcgtccttccgtaactaccgtaccttaccccgaaccgaaccgggtccctacgtttcccccgg

SEQ ID NO: 331008 - DNA, 660 bp, Homo sapiens
  misc_feature: GZ8MTXP02GA4B4.44.57.F02.1.454.CMB.2.raw
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgccatgtctcgtggtatttccattcagttctgatctattcgttggggctggatccggcacgccccgaggggagggatggaggtggatggtgacagtcctattagacgtgggcgtactacgtactccgtccgtcccctacagtacgtcgtcctcctacctgtttcggacgggtactaccgtaccaagtacgaacccgtacttccctaccccgtagtaaaactcgacccttacccggacggaacccgcccggacggacccgaaccgggttccgttttaacttccgtaggttcgacggacgggtccgtaacggtcgttcggttactttacaaacgttcgtaacggttcgggggtcctgggccctcccgttagggtacctacggttcctcttccctaacgtacggtaccttcccggaacccgtaacgggtcccctaacgtttcccccgg

SEQ ID NO: 331009 - DNA, 664 bp, Homo sapiens
  misc_feature: GZ8MTXP02FTPTS.44.57.F02.1.454.CMB.2.raw
  modified_base (376)..(376): a, c, t, g, unknown or other
  misc_feature (376)..(376): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggaggggaagtggaggtggagttggtgacatcctattagtacgtggggacgtacgtactactctccgtcccctacaacgacgtcgtctcacctnttcgacggacaccgtctactcgaccgtcttcctccctagaaaacctcgaacccgtcccgtcggacccgtcccggaccgggaacccgaccgggttacccgttttaacgtttccgttaggtcggccggtagggaccgtacgtaccgttggttaccttttacgaacgttaccgttagggtcgggggtcccggtgggtccccgtaacccggttcgggtacctaccgtcgttcccttccctcgtaacgtccctttaccccgaaccgaaccgggtcccctacgtttcccccggg

SEQ ID NO: 331010 - DNA, 591 bp, Homo sapiens
  misc_feature: GZ8MTXP02F8JMV.44.57.F02.1.454.CMB.2.raw
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagacagtatatacacgaccggtgctcgatttagctcgatatagttgggtttgggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgtggggctggatccggcacgccccgagggagggatggagtggagttggtgacatccattactacgtggggcgtacgtactactcctccgtcccctnaagcgtcgtctacactntttcgagggacacgtcatcgaaaccctcgttacctaccctagtaaacctcgtaccctcgtccgaccggcccgcggaaccgacggttccgtttacttcgtaggttcgcggacgggtccgaagtcgttaggtcgtttacaagtcgtaggtcggggcgtcgccgtaccgtggtcctactcgtcctcctcgacgtccttaccaccggtaacggccctacgtttccccgg

SEQ ID NO: 331011 - DNA, 610 bp, Homo sapiens
  misc_feature: GZ8MTXP02HUIE1.44.57.F02.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcactgtctctggactttccattcagttctgatcattcgttgggctggatccggcacgccccgaggggacgggaagtggagtggagttggngactagtccattatacgtggggcacgtactacctcgtcctcccctanagtntcgtctacactnttcgaggacacgtcatcgaccgtcttccaccctagaaacctcgacccgttccgtcgacccgccgcggacgtaccgtccgttttatttccgtgttgcgagggtcgagtacgtggttaccttgaattcgtagtcggggtccgtggtcctacccgtgggttcccacgttcggttcctacccgttaaccgtacggttccccttacccgaaccgaaaccggggtcccccttaacgtttcccccggg

SEQ ID NO: 331012 - DNA, 491 bp, Homo sapiens
  misc_feature: GZ8MTXP01EEPAF.17.57.F02.1.454.CMB.2.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagcaactttaaatggtatcagcgggaaccagggaaancccctaaatcctgatctatactgcatccaatttgcaaagtgggtccatcaaggttcagtgcagtggatctgggacagatttcactctcaccatcagcagtctgcaactgaggattttgctaacttactactgtcaacagggttacagtaccccgtanactttggccaaggggccaagcttgggaanattacgaacgactgtgctgcactnttcgtg

SEQ ID NO: 331013 - DNA, 527 bp, Homo sapiens
  misc_feature: GZ8MTXP01BHRSA.17.57.F02.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagcgtagactagcacgaccggtgctcgatttagctcgatatagttgggtttgggggagtcagtctcagtcaggacacagcatggacatggacgggtccccgctcagctccgtggggctcctgctactctggctccgaggtgccagatgtgacatccagatgacccagtctccatccctccctgtctgcatctgtagganacagagtcaccatctcttgccgggcaagtcagagcattagctaaactttttaaatggtatcaggcgggaaccagggaaacncccctaaatccngatctatactgcatccaatttgactaaaggtcgggtacccatcaaggttcagtggctagtggatcgtgggacagtatttcactctcacatcagcagtctgactaactgagtatttcgactaacttactactgtacaacgtagggtaccacgtacccgtatcgtttcggaccgagggaccaagcttgggaaanacgtaacaacgacgttgacgctnaaccacnttctcgttctc

SEQ ID NO: 331014 - DNA, 573 bp, Homo sapiens
  misc_feature: GZ8MTXP01B9RMG.17.57.F02.1.454.CMB.2.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggnaagtcagagcattagctaaactttaaatggtatcagcgggaaaccagggaaacncccctaaatcctagatctaatactgcatccaatttgacaaagtcgggtacccatcaaggttcagtggacagtggatcgtgggacagtactttcactctcaccatcagcagtctgcaactgagtatttgactaacttactactgtacaaacgtacggttaacacgttacccgtactacgttttcgggccgtaacgggggaccaaggtccgttaggggaaactaacgttaaccgaaaacggttaaccgtttgggtacgggtccttacggacccaacccgtaagtttcccgtttaacg

SEQ ID NO: 331015 - DNA, 582 bp, Homo sapiens
  misc_feature: GZ8MTXP01B9RED.17.57.F02.1.454.CMB.2.raw
  modified_base (414)..(414): a, c, t, g, unknown or other
  misc_feature (414)..(414): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
  modified_base (547)..(547): a, c, t, g, unknown or other
  misc_feature (547)..(547): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgctagggtcactcaccctgccccgattaacgtggacaggaacccttggtcttccggcgagcggtcttttcacccgtctttatcgttacctatgtcagcaattcgcacttcngactacctccagccatcgcctcacagcaacaccttcacaggcttaacacgaaacgcctacccctacccaaaccaacgcaataacgcgtacgctgccgcagccttcgngcttagtcggtttacncccccgtttnacttcctcccgctactcttagtaaccttaacgtcg

SEQ ID NO: 331016 - DNA, 546 bp, Homo sapiens
  misc_feature: GZ8MTXP01DMP12.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtccaccattctcgttcggccgggcaaagtcaagagcattagactaactttaaatggtatcgagcgggaaaccaggaaacgcccctaaactcctagatctatactgcataccaatttgacaaaggtcgggtacccatcaaggtcagtggacagtggatcgtgggacagtatttcactctcacctatcagacagtctgactaacctgagtattttgactaaacttactactgtacaacgtagggttacaacgtacccgtatacgtttcggccgtaaggggaccaaggcttaggagattaacgaaagttactggtaggctggaccaccgtaacttcttcg

SEQ ID NO: 331017 - DNA, 514 bp, Homo sapiens
  misc_feature: GZ8MTXP01C6PQG.17.57.F02.1.454.CMB.2.raw
  modified_base (479)..(479): a, c, t, g, unknown or other
  misc_feature (479)..(479): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccgggcaagtcagagcattagctaacttttaaatggtatcagcgggaaaccagggaaacgcccctaaatcctgatctatactgcatccaatttgcaaagtgggtacccatacaacggttcagtggcagtggatcgtgggacaagtattcactctcacatcagcagtctgcaactgagtattttcaacttctactgtacaaacagggttaacacgtacccgtatacgtttgcctagggaccaagctggagattacgaaacgtacngttggactgactaaccatcttagttccttcgtaac

SEQ ID NO: 331018 - DNA, 542 bp, Homo sapiens
  misc_feature: GZ8MTXP01BDXG6.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggnaagtcagagcattagctaactttaatggtatcagcgggaaccaggaaacgcccctaaactcctgatctatactgctatcctaatttgacaaagtcggggtccatacaggttcagtggacagtgatcgtgggacagtattcactctcacatcagcagtctgacaacgtgagtatttgactaacttactactgtacaacgtacgggttacacgttaccccgtactacgtttacggccgtaacggggaccaaaggtcttagggaacgtaattaccgaaacgttaacgtggtagggcttcggccacctaacgttcttaacg

SEQ ID NO: 331019 - DNA, 552 bp, Homo sapiens
  misc_feature: GZ8MTXP01DEPZC.17.57.F02.1.454.CMB.2.raw
  modified_base (282)..(282): a, c, t, g, unknown or other
  misc_feature (282)..(282): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggcaagtcagagcattagactaacttttaaatgggtatcagacgggaaaccagggaaacncccctaaatcctagatctatactgcatccaatttgacaaaggtcgggtacccagtcaaggttcagtgacagtggatcgtgggacagtatttcactctcaccatcagcagtctgacaactgagtatttgactaacttacgtactgtacaaacgtgggttaccacgttaccccgtatacgtttggacccgtaaggggaccaaggtccttagggaactacttaacgaaaccggttacttggtacggctacggccttaccctaagttccctttg

SEQ ID NO: 331020 - DNA, 534 bp, Homo sapiens
  misc_feature: GZ8MTXP01BGKSD.17.57.F02.1.454.CMB.2.raw
  modified_base (274)..(274): a, c, t, g, unknown or other
  misc_feature (274)..(274): n is a, c, g, or t
  modified_base (520)..(520): a, c, t, g, unknown or other
  misc_feature (520)..(520): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaatttttaaatggatcaggcggaaacagggaaacncccctaaatcctgatctatactgcatccaatttgactaaagtcgggtccatcaaggttcagtgcaggtgatcgtgggacagtatttcactctacacatcagcagtctagctaactgagtatttgactaacttactactgtaccaacgtacggttaaccacgttaccccgttatacgttttcgggaccgtaagggggacccaagtcgttagggacatacgaaacgacgttggttacggctgccacgnttcgtgttcttaac

SEQ ID NO: 331021 - DNA, 513 bp, Homo sapiens
  misc_feature: GZ8MTXP01D2OJ3.17.57.F02.1.454.CMB.2.raw
  modified_base (278)..(278): a, c, t, g, unknown or other
  misc_feature (278)..(278): n is a, c, g, or t
  modified_base (410)..(410): a, c, t, g, unknown or other
  misc_feature (410)..(410): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatctcttgccgggcaagtcagagcattagctaactttaaatggtatcaagcgggaaaccagggaaacncccctaaactcctgatctatactgcatccaatttgacaaagtgggtccatcaaggttcagtgcagtggatctgggacagatttcactctcaccatcagcagtctgcaactgaggtattttgactaaactttntacctgtacaacgtagggttacacgtaccccgtatacgtttcggccctaagggggaccaagcgttaggagattacaaacgactgtagctgcactaattcgtcg

SEQ ID NO: 331022 - DNA, 564 bp, Homo sapiens
  misc_feature: GZ8MTXP01A62RN.17.57.F02.1.454.CMB.2.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (554)..(554): a, c, t, g, unknown or other
  misc_feature (554)..(554): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaatggatcagcggaacaggaaacncccctaaatcctgatctatactgctatcctaatttgacgtaaaggtcggggtacccaagtccgtaaaggttcaggttcgggactaggtacgggaattcggtaggggaacctagtacttttcactctaccaccatccagcagtctagactaaccgtggagtattttcgacctaaactttactaacgtcgtaacaacgtaggttaccacgttaccccgtatacgtttcggaccgtagggaccaagcgttaggacgatacgaaacgacgttgttacggctgcacctnttctgttctc

SEQ ID NO: 331023 - DNA, 522 bp, Homo sapiens
  misc_feature: GZ8MTXP01D4UQ5.17.57.F02.1.454.CMB.2.raw
  modified_base (274)..(274): a, c, t, g, unknown or other
  misc_feature (274)..(274): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaacagggaaacncccctaaatcctgatctatactgcatccaatttgacaaaggtcgggtccatcaaggttcagtggcagtgggatcgtgggacagatttcactctcaccatcagcagtctagcaactgaggtatttcgactaactttactactgtacaacgtagggttaccacgtaccccgtatacgtttcggccagggggtaccaaaggcttgggaagatacaaacgacttggttggctgcaccattcctgttcttaac

SEQ ID NO: 331024 - DNA, 528 bp, Homo sapiens
  misc_feature: GZ8MTXP01AFKZD.17.57.F02.1.454.CMB.2.raw
  modified_base (352)..(352): a, c, t, g, unknown or other
  misc_feature (352)..(352): n is a, c, g, or t
  modified_base (515)..(515): a, c, t, g, unknown or other
  misc_feature (515)..(515): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggcaagtcagagcattagctaaacttttaaatggtatcagcgggaacagggaaacgcccctaaatcctgatctatactgcatcaatttgacaaagtgggtccatcaagttcagtggcagtgatcgtgggacngatttcactctcaccatcagcagtctgcaactgaggttatttgactaacttactactgtacaaacgtagggttaccacgttaccccgtactacgtttggacccgtaggggaaccaagcgttagggaacgataacaaacggttacttggttacggctgcaaccngttcctgttcttc

SEQ ID NO: 331025 - DNA, 568 bp, Homo sapiens
  misc_feature: GZ8MTXP01C5GUB.17.57.F02.1.454.CMB.2.raw
  modified_base (287)..(287): a, c, t, g, unknown or other
  misc_feature (287)..(287): n is a, c, g, or t
  modified_base (534)..(534): a, c, t, g, unknown or other
  misc_feature (534)..(534): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatctcttggccgggcaagtcagagcattagactaaatttaaatggtatcgaaggacgggaaaccaaggggaaacncccctaaactcctagactctatactgactatacctaatttgacgtaaaaggtcggggtacccaagttacgaaaggttcaggtggacaaggtggatcgtagggaactagtactttcactctacaccatcagcagtctagactaacgtgaaggtattttcgacttaaactttactactagtacaaaccgtagggttaaccacgttaccccgtaatacgtttcggacgtaaggggaccaaggcttagganattacgaaacacgtgtcgctgcttacaagttctg

SEQ ID NO: 331026 - DNA, 500 bp, Homo sapiens
  misc_feature: GZ8MTXP01D3RSZ.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaactttaaatggtatcagcgggaaccagggaaagcccctaaactcctgatctatactgcatccaatttgacaaagtggggtcccatcaaggttcagtggcagtggatcgtgggacagtattcactctcacatcagcagtctgcaacctgaggtattttgactaactttactactgtacaacagggttacacgtacccctacactttggcaaggggacaagcttgagattacaaacgactgtggctgcactaattctg

SEQ ID NO: 331027 - DNA, 551 bp, Homo sapiens
  misc_feature: GZ8MTXP01C4IUR.17.57.F02.1.454.CMB.2.raw
  modified_base (402)..(402): a, c, t, g, unknown or other
  misc_feature (402)..(402): n is a, c, g, or t
  modified_base (499)..(499): a, c, t, g, unknown or other
  misc_feature (499)..(499): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacctatctcttgccgggcaagtcagagcattagctaacttttaaattggtatcagcgggaaaccagggaaacgcccctaaatcctagatctaatactgcatcctaatttgactaaagtcgggggtacccagtcctaaaggttcaagtggacagtagggatcgtgggacagtactttcactctcaccatcagcagtcngacaacgtgaggtatttgactaacttactactgtacaacgtaggttacacgttacccgtactacgttttcgaccgagggtaccaaagcgttaggganagttacgaaacgttaattcgttaggaactgctaccattctcgttcgttaacc

SEQ ID NO: 331028 - DNA, 537 bp, Homo sapiens
  misc_feature: GZ8MTXP01BW2GE.17.57.F02.1.454.CMB.2.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
  modified_base (383)..(383): a, c, t, g, unknown or other
  misc_feature (383)..(383): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaactttaaatggtatcagacgggaaccagggaaacncccctaaactcctgatctatactgcatccaatttgactaaaggtcggggtcccaatcaaaggttcagtagcagtggatcgtgggacagtatttcactctacaccntcagcagtctgcaactgagtatttgactaacttactactgtacaacgtacgggttaacacgtaccccgtatacgttttcgggaccgtaacgggggaccaaaggcgttaggagaattacgaaacgttaacgtgtggctagccaactcttcgttcg

SEQ ID NO: 331029 - DNA, 517 bp, Homo sapiens
  misc_feature: GZ8MTXP01BEXZU.17.57.F02.1.454.CMB.2.raw
  modified_base (275)..(275): a, c, t, g, unknown or other
  misc_feature (275)..(275): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggatcagcgggaaacagggaaacncccctaaatcctagatctatactgacatccaatttgacaaaggtcgggtaccatcaaggttcagtgcagtggatcgtgggacagtatttcactctacaccatcagcagtctagcaactgagtatttgactaacttactactgtacaacgtaggttacacgttacccgtactacgtttcggacctaggggaccaagcgttaggagatacaaacgacgttgaggctgcaccattctgttctaac

SEQ ID NO: 331030 - DNA, 601 bp, Homo sapiens
  misc_feature: GZ8MTXP01BTRT7.17.57.F02.1.454.CMB.2.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctctgccgganagtcaganctatatacttaattaagtgtatacgaggacggaacgaaggaaccacccctaaactctagactactatactnactactactaagttagaacgtaaaggtcggtacctaagtacgtaaggttcgaggtcggaacgtaggtggactcggtagggactagtacttcacttctacactatcagtctagtcacgacctaacgtgtaagttatttacgaacttaacttactacttacgtaaccgtaaacggtacggttaacctaaccggttacccgttaacgttacggttacggaaccggtaacggggaaccaggtacgttaggaaacgtaacttaacgaacgttacgtggtcgaactcgacttacctgttccgtg

SEQ ID NO: 331031 - DNA, 599 bp, Homo sapiens
  misc_feature: GZ8MTXP01DC2XK.17.57.F02.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccgggnaagtcagancattagctaaactttttaanggatcagcggaacagggaaaccccctaaanctgatcatactgcatactaatttagtaaagtagggtccactacaagttaccgagtggngagtggaatgtgggaacgagtattactactactacaccactacacgactacgtacgtacgactaaccgtaggtaggtagtttacgtaactaaacttaacttaacgttacgtaacgtaaacgtaacggttaaccgtaaccgtaacccgttaaccgttaccgtttacggtaccggaacgggaaccgaacgtaacgtaggagaacgttaacgtaaacgtaacgttacgttcggcgtcgacaacctactacttcttcgttctaac

SEQ ID NO: 331032 - DNA, 568 bp, Homo sapiens
  misc_feature: GZ8MTXP01CJYSE.17.57.F02.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatctcttgccggganaagtcagagcattagactaactttaaatggtatcaagcgggaaaccagggaaacgcccctaaatcctagatctaatactgctatccaatttgacaaaggtcggggtaccaatcaaggttcagtggacagtgatcgtgggacagatttcactctacacatcaagctagtctagacaaccgtgaaggtatttagactaaactttactaacgtgtaccaaacgtcgggttaacaacgtaccccgttacgtacgtttcggccgtaagggggaacccaaaggccgttagggaatattaaccgaaacgttaacgtggtagggccctaggcccactaacgttcgttccg

SEQ ID NO: 331033 - DNA, 547 bp, Homo sapiens
  misc_feature: GZ8MTXP01EGIQO.17.57.F02.1.454.CMB.2.raw
  modified_base (280)..(280): a, c, t, g, unknown or other
  misc_feature (280)..(280): n is a, c, g, or t
  modified_base (499)..(499): a, c, t, g, unknown or other
  misc_feature (499)..(499): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagacttaaacttttaaatggatcgagacgggaaacagggaaacncccctaaactcctagatctatactgactatacctaattttgaacgtaaaggttcgggtacccagtacgtaaggttcagtggcaggtaggatcggtagggactagtatttccactctacaccatcagcagtctagactaactgagtatttgactaacttactactgtacaacgtaggtacacgtacccgtatacgttcgacgagggacaagcgttagganagtacaaacgttacgttgacggctcgaacacctattctcgttcttaac

SEQ ID NO: 331034 - DNA, 528 bp, Homo sapiens
  misc_feature: GZ8MTXP01CQRTX.17.57.F02.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggnaagtcagagcattagctaaactttttaaatggatcaggcgggaaaccagggaaacncccctaaatcctgatctatactgcatcctaatttgactaaaggtcgggtacccatacgaaggttcaggtggcaggtgggaatcgtagggactagtatttcactctacaccatcagcagtctgacactgagttatttgactaacttactactgtacaaacgtaggttaccacgtacccgtactacgtttcggacgaggggaccaagcgttagganatacgaanacgttgcgctgcactnttctgttcttaac

SEQ ID NO: 331035 - DNA, 530 bp, Homo sapiens
  misc_feature: GZ8MTXP01DYLK7.17.57.F02.1.454.CMB.2.raw
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (359)..(359): a, c, t, g, unknown or other
  misc_feature (359)..(359): n is a, c, g, or t
  modified_base (507)..(507): a, c, t, g, unknown or other
  misc_feature (507)..(507): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatctcttgccggnaagtcagagcattagctaaactttaatggtatcagcgggaaaccagggaaancccctaaatcctagatctaatactgacatccaatttgacaaaggtcggggtacccatcgaaagttcagtggacagtggatcgngggacagtatttcactctcaccatcagcagtctgactaacctgaagtatttacgaaacttacgtactgtacaaagtacgggttaacacgttaaccccgtactacgttttacgggcctacggggaaccaagcgtagagactacaaacgnttagtgctgccacagtcttgttc

SEQ ID NO: 331036 - DNA, 540 bp, Homo sapiens
  misc_feature: GZ8MTXP01DF9SI.17.57.F02.1.454.CMB.2.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagatcacatctctgccggnaagtcagagcattagactaaactttaatggtatcaggcgggaaaccagggaaacncccctaaactcctgatctatactgactataccaatttgactaaaggtcgggtaccatcgaaggttcagtggaacagtggatcgtagggacagtatttcactctacaccatcagcagtctgacaacgtgaggtatttcgactaactttacactgtacaacgtaggttacacgtacccgtatacgtttcggacccgaaggggaacccaggtcttaggaacgaattacgaaacgttacgtgtaggctgaccttactaagttcgtaacg

SEQ ID NO: 331037 - DNA, 552 bp, Homo sapiens
  misc_feature: GZ8MTXP01CFA3M.17.57.F02.1.454.CMB.2.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (508)..(508): a, c, t, g, unknown or other
  misc_feature (508)..(508): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatctctgccgggnaagtcagagcattagactaactttaatggtatcaggacgggaaaccaagggaaacncccctaaactcctagatctaatactgactattacctaagttttcgacgtaaaggtcggggtaccctaagttaccgtaaaggttcaggtggacaggtggatcgtagggacagtattcactctcacatcagcagtcngactaacngagtatttgactaacttactactgtacaacgtacggttacacgtaccctatacgttcggccgtaagggaccagcgttagggaanacttaacgaaacgttactggtcgctcgaccacctaattcgttcg

SEQ ID NO: 331038 - DNA, 570 bp, Homo sapiens
  misc_feature: GZ8MTXP01B3GOA.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctggtaggagacagatcaccatctcttgccgggnaagtcagagcattagactaaactttaatggtatcaggacgggaaacagggaaacacccctaaactcctagatctatactgcatacctaatttgacaaaggtcggggtaccctatacgtaaggtcaggtggacagtggatcgtgggacagtacttacactctacaccatcagcagtctgacaactgaaggtattttacgacttaacttactactgtactaacgtaggttacctaccgttacccgtatacgtttcggccgaaggggaccaaggcgttaggaaacgtattaaaccgaaacgttaaccgttggcgggtaacttcgaccttaaccctaatttccgttcg

SEQ ID NO: 331039 - DNA, 612 bp, Homo sapiens
  misc_feature: GZ8MTXP01C3NP2.17.57.F02.1.454.CMB.2.raw
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
  modified_base (413)..(413): a, c, t, g, unknown or other
  misc_feature (413)..(413): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatctcgttcggcccggganaaggtcaagagctaattagacttaaacttttaaatggtaatcgaggacgggaaaccagggaaacgcccctaaactcctagactctatacngacattccaatttgactaaaggtcgggtcccaatcgtaaaggttcagtggaacagtggatcgtagggactagactttcactctacacctancagcagtctacgacctacgtgtaagttatttacgacttaacttactaacgtacgtaacgtaacggtaacggttacctaaccggttaccccgttacgttaccggttacgggacccggaacgggtaaccacggtacgttaggaaacgtaacttaaaccgaaacgttacgttggtcgcgtacgaccttactcgttccgttcg

SEQ ID NO: 331040 - DNA, 510 bp, Homo sapiens
  misc_feature: GZ8MTXP01C12TK.17.57.F02.1.454.CMB.2.raw
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaactttaaatggtatcagcgggaaaccagggaaancccctaaatcctgatctatactgcatccaatttgacaaagtggtccatcaagttcagtgcagtggatcgngggacagatttcactctcaccatcagcagtctgacaacctgagtatttcgactaacttactactgtacaacgtagggttacaacgttaccctatacgtttcggccgtaaggggccaaaggcttaggacgattacgaaacgactgagctgcactaattctcg

SEQ ID NO: 331041 - DNA, 771 bp, Homo sapiens
  misc_feature: GZ8MTXP01DNIHK.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatctcttgccggnaagtcaagagcattagactaactttaaatggtatcaagcgggaaaccagggaaacgcccctaaactcctgatctatactgacattaccaatttgactaaaggtcgggggtacccctagtacgtaaaggtttcaaggttggacctaagggttggggaacttaccgttagggggaaacctaaggtaactttttcaaacccttcccttaccgaaacccctaacgtacgaacgtaccgtaacggttccgtacggtaacccgtaaaccggttaggtaaacgggtttaactttttaccgaaaccgtttaaaaccgtttaaacgttaaccgttaacggttaaaccgtaaaaccggttaacggggtttaaacccgtaaacccggtttaaaccccgttaaccgtttaaccggttttaccggggaacccgggtaaaccgggggtaaaccgaaacggtaccggttaacggtaaacgttaacgttaaaaccggaaaaccggttaacggtaacgggtacggtaaccgttacgacccttaccgtaacgttccgtttaacg

SEQ ID NO: 331042 - DNA, 548 bp, Homo sapiens
  misc_feature: GZ8MTXP01AYYQ9.17.57.F02.1.454.CMB.2.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaatggatcagcgggaacagggaaacncccctaaatcctgatctatactgcatccaatttgacaaagtcgggtccatcaagttcagtgcagtgatcgngggacagatttcactctcacatcagcagtctgactaactgagtatttgactaacttactactgtacaaacgtagggttacacgttaccccgtactacgttttcggaccgtaaggggaccaagtccgttagggaacgaacttaaccgaaaacgttacgttggttacggccttggcctaacccattccgttgttcctttaaccg

SEQ ID NO: 331043 - DNA, 563 bp, Homo sapiens
  misc_feature: GZ8MTXP01BNHAX.17.57.F02.1.454.CMB.2.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (356)..(356): a, c, t, g, unknown or other
  misc_feature (356)..(356): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagancattagctaacttttaaatggtatcagcgggaaccagggaaacncccctaaactcctagatctatactgacatcctaatttgacaaaggtcgggtacccatcgaaggttcagtgcagtggatcgngggacagtatttcactctacaccatcagcagtctagcaactgaggtatttgactaacttactactgtacaacgtagggttaccacgtacccgtactacgttttcggaccgtacggggaacccaaggtccgttagggaacgacgttaaccgaaaacgttaacgttggttacggcttagccctaacctattccttcgttcctttaaccg

SEQ ID NO: 331044 - DNA, 534 bp, Homo sapiens
  misc_feature: GZ8MTXP01ERDE6.17.57.F02.1.454.CMB.2.raw
  modified_base (227)..(227): a, c, t, g, unknown or other
  misc_feature (227)..(227): n is a, c, g, or t
  modified_base (502)..(502): a, c, t, g, unknown or other
  misc_feature (502)..(502): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatctcttgccgggnaagtcagagcattagactaaactttaaatggtatcgagacgggaaaccagggaaacgcccctaaatcctagatctatactgcatcctaatttgacaaaggtcggggtcccatcgaaggttcagtggacagtggatcgtgggactagtattcactctacaccatcagctagtctagacaaccgtgacggtatttgactaactttactactgtacaacgtagggttaccacgttacccctactacgtttggccgaagggaccaaggcgttaggagtnacgaaacgactggaggctgcactaacttctcg

SEQ ID NO: 331045 - DNA, 527 bp, Homo sapiens
  misc_feature: GZ8MTXP01BLMWM.17.57.F02.1.454.CMB.2.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
  modified_base (487)..(487): a, c, t, g, unknown or other
  misc_feature (487)..(487): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaactttttaaatggtatcagcgggaaaccaggggaaacncccctaaatcctagatctatactgacatccaaatttgacaaaggtcgggtccatcaacggttcagtgcagtgatcgtgggacagtatttcactctacaccagtcagcagtctagcaactgagtatttgactaacttatactgtacaacgtacggttacacgttacccgtactacgttttcggaccgtaggggaccaaggcgttaggganacgtacaaacgacgttggttaggctgcacattctgttctc

SEQ ID NO: 331046 - DNA, 524 bp, Homo sapiens
  misc_feature: GZ8MTXP01C3KRL.17.57.F02.1.454.CMB.2.raw
  modified_base (224)..(224): a, c, t, g, unknown or other
  misc_feature (224)..(224): n is a, c, g, or t
  modified_base (381)..(381): a, c, t, g, unknown or other
  misc_feature (381)..(381): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggganaagtcagagcattagactaactttttaaatggtatcaggcggaaccagggaaacgcccctaaatcctagatctatactgacatcctaatttgactaaaggtcgggtacccatacgaaggttcaggtggcagtggatcgtgggacagtatttcactcncacatcaagcagtcagactaaccgtgacgttatttcgactaacttactactgtacaacgtaggttacacgtacccgtatcgttgcgagggacaagcttagganatacaacgttacgttgttacgctgcacnttctcgttcttc

SEQ ID NO: 331047 - DNA, 528 bp, Homo sapiens
  misc_feature: GZ8MTXP01D9JGS.17.57.F02.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
  modified_base (496)..(496): a, c, t, g, unknown or other
  misc_feature (496)..(496): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtagganacagatcaccatctctgccggnaagtcagagcattagactaaactttaaatggtatcgaaggcgggaaaccagggaaacncccctaaactcctgatctaatactgctattaccaatttgacgtaaaggtcggggtacccagtacgaaggttcagtggaacagtggatcgtagggactagtacttcactctacaaccntcagcagtctagcaacgtgagtatttcgactaacttactactgtacaacgtaggttacacgtccctatacgtttcggcgaagggacaggcttagganacttacgaagcgtgtgctcgcactaattctcg

SEQ ID NO: 331048 - DNA, 597 bp, Homo sapiens
  misc_feature: GZ8MTXP01C3PLY.17.57.F02.1.454.CMB.2.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatctcttgccgggcaagtcagagacattagactaaactttaaatggtatcgaaggcgggaaaccagggaaacncccctaaatcctagactctatactgactattaccaatttgactaaaggtcgggtacccaattcgaaaggttcaggtgaacagtggatcgtagggacagtacttcactctacacatcancagtctagacaactgtacgtatttgactaactttactactacgtaactaaacgtacgggttaacctaccggtaaccccgtagtaccgtttcggacccggtaagggggtaaccaagggtccttaggggaaatacgttaacccgaaaacgttacgtaagggtcggtaactacggaccttaaccctaattcggttccg

SEQ ID NO: 331049 - DNA, 580 bp, Homo sapiens
  misc_feature: GZ8MTXP01CSA9Q.17.57.F02.1.454.CMB.2.raw
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctcatcctccctgtctgcatctgtaggagacagagtcaccatctctgccggnaagtcagagcattagactaactttaaatggtatcgagacgggaaccaggaaacncccctaaactcctagatctatactgactactacaatttgactaaaggtcggggtacccatcgaaggttcaggtgacagtgatcgtagggactagtacttcactctcaccatcgagcagtctagaccaacgtgtaaggtattttagaccttaaactttactacgtacggttacaaacgtacgggtttacaaccggttaccccgttaactacgtttacggaccgtaaggggaacccaaggtccgaggtaaacgtacttacgaaaacgacgttaagggacgtctcggacttaaccgtcttcgttcg

SEQ ID NO: 331050 - DNA, 599 bp, Homo sapiens
  misc_feature: GZ8MTXP01A68NZ.17.57.F02.1.454.CMB.2.raw
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
  modified_base (583)..(583): a, c, t, g, unknown or other
  misc_feature (583)..(583): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggnaagtcagagcattagactaactttttaatggtatcgagcgggaacagggaaacncccctaaatcctgatctatactgacatacctaatttgacgtaaaggttcggggtaccccaagtcgtaaacggttcaaggtggcaggtagggaatcgtaggggaacctaggtactttccaccttctaccaacctatcagccagttctgacctaacgtgagttatttcgactaacttactactgtacaacgtagggttaccacgttacccgtactacgtttcggaccgtacggggtaaccaaggcgttagggaaacgacgtaaccgaaaacgttaaccgttggttcggaactcggaacccaaccgttnttccttcgtttcctcg

SEQ ID NO: 331051 - DNA, 595 bp, Homo sapiens
  misc_feature: GZ8MTXP01D4ZFP.17.57.F02.1.454.CMB.2.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccactcctcctgtctgcatctgtaggagacagagtcaccatctcgtcggccgganaagtcagngctattagacttaaactttaatggtatcgaggaccggaaaccgagggaaacctacccctaaactcctagactctaatactgactacttacctaatttgactaaaggtcggtacccatcgtaaggtcaggtgaacagtgatcggtagggacagtacttcactctacactatcagctagtcctagacctaacgtgaaggttatttacgacgttaaactttactacgttacgtacctaacggtacgggttacaacccgttacccgtacgttacgttcggaccgaacggggtaccaggtccgttaggaacgtacgttaaccgaaacgttactggtacgctcgacttacctaacttcgttccg

SEQ ID NO: 331052 - DNA, 551 bp, Homo sapiens
  misc_feature: GZ8MTXP01DBUDV.17.57.F02.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (544)..(544): a, c, t, g, unknown or other
  misc_feature (544)..(544): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccggnaagtcagagcattagactaactttaatggtatcaggcgggaacagggaaacncccctaaactcctagatctatactgactatccaatttgactaaagtcgggtcccatcaaggttcagtggacagtggatcgtgggactagtatttcactctacacatcagcagtctgcaactgagtatttcgctaaacttctacttgtaccaaacgtacgggtttacaccggttaccccgttactacgttttcgggacccgtaagggtaccccaaggtccttaggagtaacttacgaaacgttaacgttggtacgcttagccttacctnttcgtcg

SEQ ID NO: 331053 - DNA, 516 bp, Homo sapiens
  misc_feature: GZ8MTXP01E1JN7.17.57.F02.1.454.CMB.2.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
  modified_base (498)..(498): a, c, t, g, unknown or other
  misc_feature (498)..(498): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccgggnaagtcagagcattagctaactttaaatggtatcagcgggaaccagggaaacncccctaaactcctgatctatactgcatccaatttgacaaagtgggtcccatcaaggttcagtggcagtggatcgtgggacagatttcactctcaccatcagcagtctgacaacctgaggtatttgactaacttactactgtacaacgagggttaccacggtaccccgtataccgtttgggccaaggggtaccaagcttaggagaattcgaaaacgacttgnggctgccactaattctcg

SEQ ID NO: 331054 - DNA, 638 bp, Homo sapiens
  misc_feature: GZ8MTXP01BX1CQ.17.57.F02.1.454.CMB.2.raw
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatctcttgccgggcaagtcagancattagctaaactttttaaatggtatcagcggaaccagggaaacncccctaaactcctgatctatactgcatcctaattttgactaaaggtcggggtacccagtaccgtaaggtttcagtggcaggtagggatcgtgggacagtattcactctcacatcagcagtctgactaacgtgaggttacttagacttaacgtttactacgttacgtaaccgtaacggttaacgggttaacctaacccggtttacccgttaacgtttaccggtttaccgggaacccgggttacggggaaccctaaagggtccgttaggggaaacttacgtaaacccgaaaaggttaccgttggggttacgttaaccgacggtaacctaaacccgtttacgttccgttaacgtttccgttaacg

SEQ ID NO: 331055 - DNA, 559 bp, Homo sapiens
  misc_feature: GZ8MTXP01C97AW.17.57.F02.1.454.CMB.2.raw
tcagcgtagactagcacgaccggtgctcgatttagctcgatatagttggggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcacatctctggccgggcaagtcagagcattagactaaactttaaatggtatcgaggcgggaaaccagggaaacacccctaaatcctgatctatactgactataccaatttgacgtaaaggtcggggtaccctaagttaccgtaaagggtttcaaggttcgggactaagggttggatcggtaggggactagtactttcactctacaccagtcagcagtctgacaacgtgagtatttgactaacttactactgacaacgtaggtacacgtaccctatcgtttcggccgtaagggaaccaggtcttaggaagtaacttacgaaacgacgtgaggctgaccactaagttcgttcg

SEQ ID NO: 331056 - DNA, 562 bp, Homo sapiens
  misc_feature: GZ8MTXP01BO9FX.17.57.F02.1.454.CMB.2.raw
  modified_base (236)..(236): a, c, t, g, unknown or other
  misc_feature (236)..(236): n is a, c, g, or t
tcagcgtagactagcacgaccggtgctcgatttagctcgatatagttgggtttggggggagtcagtctcagtcaggacacagcatggacatgagggtccccgctcagctcctggggcctcctgctactctggctccgaggtgccagatgtgacatccagatgacccagtcctccatccctccctgtctgcatctgtaggagacagagtcaccatctcttggccgggcaagtcagancattagctaactttttaaatggtatcagcgggaaccagggaaagcccctaaactccctgactctatactgacatacctaatttgacaaaggtcggggtacccataccgtaaggttcaggtggctagtgggaatcgtggggaactagtactttcactctcaccatcagcagtctgcaactgaggtatttgactaacttactactgtacaacgtacggttacacgtacccgtactacgttttggaccgtaggggaccaagcgttaggacgacgtaacgaaacgttacgttggttcgggcttacggcaccattcttcgttctttaaccc

SEQ ID NO: 331057 - DNA, 569 bp, Homo sapiens
  misc_feature: GZ8MTXP01EE88E.17.57.F02.1.454.CMB.2.raw
  modified_base (278)..(278): a, c, t, g, unknown or other
  misc_feature (278)..(278): n is a, c, g, or t
  modified_base (545)..(545): a, c, t, g, unknown or other
  misc_feature (545)..(545): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggcaagtcagagcattagctaaactttttaaatggatcagcgggaaacagggaaacncccctaaatcctagatctatactgactatcctaattttgactaaaggttcggggtacccatcgaaaggttcaggtggcagtcgggatcgtgggactagtatttcactctcaccatcagcagtctagactaacgtgagttatttgactaacttactactgtacaacgtagggttaccacgttacccgtaactcgttttggaccgtaacggggacctaaaggtcgttaggggaacttacgtaaacgaaacgttacgttggacgcgtacncctactcgttcttcgttcttaacc

SEQ ID NO: 331058 - DNA, 619 bp, Homo sapiens
  misc_feature: GZ8MTXP01A73Q6.17.57.F02.1.454.CMB.2.raw
  modified_base (223)..(223): a, c, t, g, unknown or other
  misc_feature (223)..(223): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaaacttttaatggtatcgagcggaaccagggaaacacccctaaatcctagatctatactgacatacctaatttgactaaaggtcgggtaccatcgaaggttcagtggcaggtagatcgngggactagtacttcactctacactntacagcagtctaggacctaacgtggtaaggtacttttcgaacttaaaccttacgtaacgttgtaaccgaaacgttacggggttaaccaaccggttaaccccgtaacgttacgtttacggggacccgtaagggggaccctaaagggtccttaggggaaacttacgtaaccgaaaacggttacgttcgggttacgggcttacggaacctaacccggttattaccgttcgttccttaa

SEQ ID NO: 331059 - DNA, 559 bp, Homo sapiens
  misc_feature: GZ8MTXP01DKESO.17.57.F02.1.454.CMB.2.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctctggccggnaagtcagagcattagctaactttaatgtatcagcggaaccaggaaacgcccctaaactctgatctatactgcatccaatttgactaaaggtcggggtacccatacgaagttcagtggacagtggatcgtgggacagtattcactctacaccatcagcagtctgactactgtagtatttgactaactttctacgtgtacaacgtagggttaaccacggttaccccgtattaccgtttacgggcccggaagggggaacccaaggtccgttagggaaagtacttaacgttaaaacgttaacgtgggacgtcgtgacccttactaacttcgttaacg

SEQ ID NO: 331060 - DNA, 503 bp, Homo sapiens
  misc_feature: GZ8MTXP01AY098.17.57.F02.1.454.CMB.2.raw
  modified_base (196)..(196): a, c, t, g, unknown or other
  misc_feature (196)..(196): n is a, c, g, or t
  modified_base (491)..(491): a, c, t, g, unknown or other
  misc_feature (491)..(491): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatctcttgccgggcaagtcagagcattagctaacttttaaattggatcagcgggaaccagggaaagcccctaaactcctgatctatactgcatccaatttgcaaagtgggtcccatcaaggttcagtgcagtgatcgtgggacagatttcactctcaccatcagcagtctgacaacctgaggtatttgactaacttacgtactgtacaacgtagggttacacgtaccccgtatacgtttggacctaggggccaagcttaggagatacaaagacttgttgctgcncattctgttctc

SEQ ID NO: 331061 - DNA, 558 bp, Homo sapiens
  misc_feature: GZ8MTXP01DOVL4.17.57.F02.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatctcttgccgggnaagtcagagcattagacttaaactttttaaatggtatcgaggacgggaaaccaagggaaaccncccctaaactcctagatctatactgctatcctaattttgactaaaggtcgggtacccatcgtaacggttcaggtggctagtaggatcgtagggactagtattcactctacacatcagcatctgacactgacgtatttgactacttagtactgttacaacgtaggttacacgttacccgtactacgtttcgaccgtacggggaccaaggtcgttggacgactaacgaacgttaacgttggttcggtccngtaaccaacctnttctcgttctcg

SEQ ID NO: 331062 - DNA, 533 bp, Homo sapiens
  misc_feature: GZ8MTXP01EF3QD.17.57.F02.1.454.CMB.2.raw
  modified_base (272)..(272): a, c, t, g, unknown or other
  misc_feature (272)..(272): n is a, c, g, or t
  modified_base (378)..(379): a, c, t, g, unknown or other
  misc_feature (378)..(379): n is a, c, g, or t
  modified_base (383)..(383): a, c, t, g, unknown or other
  misc_feature (383)..(383): n is a, c, g, or t
tcagcgtagactagcacgaccggtgctcgatttagctcgatatagttgggtttgggggagtcagtctcagtcaggacacagcatggacatgagggtcccgctcagctcctggggctcctgctactctggctccgaggtgccagatgtgacatccagatgacccagtctccatcctccctgtctgcatctgtagagacagagtcaccatctcttgccgggcaagtcagagcattagctaactttttaaatggatcagcgggaaccagggaaancccctaaatcctagatctaatactgacattccaatttgacaaaggttcgggtaccatcaagttcagtggcagtgatcgtgggacagatttcactctcaccatcganntctnacactagagtattatactacttacttactagtactaacgtaacgtacgtaccgtacccgtacgtacgttacgtacgtacggacgaacgtacgttagtacgacgtaacgtaacgaacgttcgttcgtgtgaacactacttactcgttcgtc

SEQ ID NO: 331063 - DNA, 571 bp, Homo sapiens
  misc_feature: GZ8MTXP01B4BVJ.17.57.F02.1.454.CMB.2.raw
  modified_base (345)..(346): a, c, t, g, unknown or other
  misc_feature (345)..(346): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
  modified_base (525)..(525): a, c, t, g, unknown or other
  misc_feature (525)..(525): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacagaatattaacctgttcccatcgactacgccttcggcctcgccttagggtcactcaccctgccccatacgtgacagacctgctcgnngcggcttcnccgtnttatcgttactatgtcagctaattcgctacttctgactacctcagccatcgcctcacacgcacaccttcacaggcttaacacgaaccncctacccctaacccaaacaacgcaactaagcgtccgctcgccgcngtcttcggcgtccttagttcgggttttaaccnccccgttttcacttccttccccgctactcttgtaaccttaagtccc

SEQ ID NO: 331064 - DNA, 565 bp, Homo sapiens
  misc_feature: GZ8MTXP01AXI1O.17.57.F02.1.454.CMB.2.raw
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (545)..(545): a, c, t, g, unknown or other
  misc_feature (545)..(545): n is a, c, g, or t
tcagcgtagactagcacgaccggtgctcgatttagctcgatatagttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgtgacaggacctggctccggnagcggctttcacccgntttatcgttaccttangtcagcaattcgcacttctgatacctcagcatgcctcacngcacaccttcacnggcttacagaaccgctcccctaaccaaacaaccgcaactaaagccgtcgcctcgccgcagctcgttcggcagtgttacgttcccgttccttactcttcccgtcccnctcttctaacttaactaacc

SEQ ID NO: 331065 - DNA, 540 bp, Homo sapiens
  misc_feature: GZ8MTXP01D0MSD.17.57.F02.1.454.CMB.2.raw
  modified_base (230)..(230): a, c, t, g, unknown or other
  misc_feature (230)..(230): n is a, c, g, or t
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
  modified_base (532)..(532): a, c, t, g, unknown or other
  misc_feature (532)..(532): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcgttggccggganaagtcagagcattagacttaaactttaatggtatcgagacgggaaaccagggaaacncccctaaactcctagatctaatactgacatcctaatttgactaaaggtcgggtaccagtctaaggtcaggtcggactagtggatcgngggacagtacttcactctacacatcagcagtctgaccactgagttatttcgactaacttactactagtacaacgtacggttactaacgttacccgtactacgtttcggacggaacggacaggcgttaggacattacgaacgttacgtgtgctgcactnttcgttcg

SEQ ID NO: 331066 - DNA, 687 bp, Homo sapiens
  misc_feature: GZ8MTXP01C8213.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggcaggagtcagtctcagtcaggacacagcatggacatgagggtccccgctcagctcctgggggtcctgctactctggctccgaggtgccagatgtgacatccagatgacccagtctccatcctccctgtctgcatctgtaggagacagatcaccatctctgccgggnaagtcagagcattagactaaactttttaaatggtatcgaggacgggaaccaagggaaacgcccctaaactcctgatctaatactgactactaccctaaatttgacgtaaaaggtcgggggtaccccaagtacccgtaaagggtttcaaggtcggaccgtaaaggttagggtaattccggtagggggaacctaaaggttactttaccaactctacacctatcaggtctaagtcttacgacctaacccgtggtaacggttatttttacgaccttaaacgtttaaccttaacttacgtacgtaaacgttacggggttaacctaaccggttaacccccgttaaccgttaccgttttacgggacccgtaaacgggggtaaccctaaaggccgttaaggagtaaacgtaccgaaaacggttacgttaggtaacggacttcggacctaccttacgtccttcgtttaaccc

SEQ ID NO: 331067 - DNA, 544 bp, Homo sapiens
  misc_feature: GZ8MTXP01DCUTE.17.57.F02.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (387)..(387): a, c, t, g, unknown or other
  misc_feature (387)..(387): n is a, c, g, or t
  modified_base (538)..(538): a, c, t, g, unknown or other
  misc_feature (538)..(538): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaactttaatggtatcaggacgggaaaccagggaaacncccctaaatcctagatctatactgacattccaatttgactaaaggtcggggtacccagtaccaaggttcaagtggactagtggatcgtgggacagtatttcactctnaccatcagtcagtctgacaactgagtatttgactaactttactactgtacaacgtacggttacacgtacccgtatacgtttcggccgtaaggggacccaaggtcgaggtaacgaattacgaaacgttactgtacggctaggcttaaccttnttcgtg

SEQ ID NO: 331068 - DNA, 608 bp, Homo sapiens
  misc_feature: GZ8MTXP01D0FXX.17.57.F02.1.454.CMB.2.raw
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctctggccgggcaagtcagagcattagacttaaatttaatggtatcgagacgggaacagggaacncccctaaatcctagatctatactgactatacctaatttcgacgtaaaggtcgggtacccaagtacgtaaggttcaggtggactaggtggatcgtagggactagtacttcactctacactatcagctagtctgacctaacgtgtaagtattttcgacttaaacgtttactacttacgtaacgtaaacgtacgggtttaaccaaccggttaaccccgtacgttacgtttcgggacccggtaaacggggaacccaagggtccttagggaataaccgttaacgaaaacgttaccgttggtacggtctacgaccttaccgtaagttcgttccg

SEQ ID NO: 331069 - DNA, 557 bp, Homo sapiens
  misc_feature: GZ8MTXP01AHC54.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (392)..(392): a, c, t, g, unknown or other
  misc_feature (392)..(392): n is a, c, g, or t
  modified_base (551)..(551): a, c, t, g, unknown or other
  misc_feature (551)..(551): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggnaagtcagagcattagactaactttaatggtatcgagcgggaacagggaaacgcccctaaactcctagatctatactgcatcctaatttcgactaaacggtcgggtacccagttcgaaggttcagtggacaggtgatcgtagggactagtatttcactctcacatcancagtctgacactgaggttatttacgacgttaacttactacgtacgtactaaccgtagggtacctaaccggtaccccgttacgtacgtttcgggccgtaaggggacccaaagtcgttagggactaacgttacgaaacgttactggtacgcgtgccacctnttcgtg

SEQ ID NO: 331070 - DNA, 549 bp, Homo sapiens
  misc_feature: GZ8MTXP01CM86G.17.57.F02.1.454.CMB.2.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (360)..(360): a, c, t, g, unknown or other
  misc_feature (360)..(360): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctcctgtctgcatctgtagganacagatcacatctctgccggnaagtcagagcattagactaaactttttaatggatcgaggacggaacaagggaaacncccctaaactcctgactctatactgcatcctaatttgacgtaaaggtcgggtaccagtacgtaaggttcaggtggcaggtgatcgngggacagtattcgacttcacacatcagcagtctgactacgtgtagttactttgactaacttactactagtacaacgtacggtaccacgttacccgtactacgttcggacgtacgggacctaagcgttaggacgactaaccgaacgacgttggacggtctacgcctaactcttaccgtcgttctttaacc

SEQ ID NO: 331071 - DNA, 559 bp, Homo sapiens
  misc_feature: GZ8MTXP01CB94Z.17.57.F02.1.454.CMB.2.raw
  modified_base (221)..(221): a, c, t, g, unknown or other
  misc_feature (221)..(221): n is a, c, g, or t
  modified_base (413)..(413): a, c, t, g, unknown or other
  misc_feature (413)..(413): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctctgccgggnaagtcagagcattagactaaactttttaaatggtatcgaggacgggaaccgagggaaacgcccctaaactcctgatctatactgctataccaattttgactaaaggtcgggtacccatacgaaggttcagtgcagtggatcgtgggactagtactttcactctacacatcagcagtctgactaactgagttntttgactaacttacgtactgtacaacgtaggttacctacgtacccgtactcgtttcggacgtacgggaccaaggcgttaggacgaacgtaccgaaacgttacgttggttacggtctagcctacctattccttcgttcctttaaccg

SEQ ID NO: 331072 - DNA, 517 bp, Homo sapiens
  misc_feature: GZ8MTXP01AI04D.17.57.F02.1.454.CMB.2.raw
  modified_base (370)..(370): a, c, t, g, unknown or other
  misc_feature (370)..(370): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggcaagtcagagcattagctaactttaatggtatcagcgggaaccaggaaacgcccctaaactcctagatctatactgcatccaatttgacaaagtcgggtccatcaggttcagtgacagtgatcgtgggacagtattcactctcacntcagctagtctgacaaccgtgaggtattttcgactaacttactactgtacaacgtggttaccacgtacccgtactacgtttcggccgtaagggaccttaaggcgttggagacttacgaacgactggtgctgccacctaattcgttcg

SEQ ID NO: 331073 - DNA, 608 bp, Homo sapiens
  misc_feature: GZ8MTXP01ENP3F.17.57.F02.1.454.CMB.2.raw
  modified_base (465)..(465): a, c, t, g, unknown or other
  misc_feature (465)..(465): n is a, c, g, or t
  modified_base (559)..(559): a, c, t, g, unknown or other
  misc_feature (559)..(559): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtcaccatctcgttggccgggacaagtcagagctattagacttaaactttttaatggtatcgaggaccgggaaaccgaagggaaacctacccctaaactcctagactactaatactgactacttacctaagtttcgacgtaaaggttcgggtaccctagtacgtaaaggtttcaaggttcggactaaggtggtaacttcggaggggtaacctagtactttaccactctacacctatcagctacgtctacgacctaacgngtagttactttcgacttaaccttactactacggtacctaacgtacggttaccacgtaccctatcgttcgacgtacgggaccaaggcgttagganacgtacaaacgagttgaggctacgctaacctgttacttgttcttaaccg

SEQ ID NO: 331074 - DNA, 614 bp, Homo sapiens
  misc_feature: GZ8MTXP01DCRIP.17.57.F02.1.454.CMB.2.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
tcagcgtagactagcacgaccggtgctcgatttagctcgatatagttggggtttgggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggacaagtcagagcattagacttaaactttttaatggtatcgagacgggaaacagggaaacncccctaaatcctagatctatactgacatacctaatttgacgtaaagttcgggtaccagtacgtaaggttcagtggactaggtaggacttcgtggggaactagtactttccacttcacacctatcgacgcgtagtcgagtacctaaccgttggaacggttatttcgaacttaacttacttactagtaccaaacggtacggttaacctaccgttaacccgtacgttacgtttcggaccggtaacgggaaccaaggtcgttagggaacgacgtaaccgtaaaacgttacgttggttacggtctcgaacctactcgttacttcgttcttaacccg

SEQ ID NO: 331075 - DNA, 543 bp, Homo sapiens
  misc_feature: GZ8MTXP01EAUMA.17.57.F02.1.454.CMB.2.raw
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctcttgccgggcaagtcagagctattagactaaactttaaatggtatcaggacgggaaaccagggaaacncccctaaactcctgatctatactgcatccaatttgactaaaggtcgggtacccatacgaaaggttcagtggacaaggtggatcgtgggacagtacttcactctcacatcagcagtctgcactgagtatttgactaacttatacttagctaacgtaggttaaccacgtacccgtagtacgtttcggcgaacgggtacagcgttagggaactacgttacgaaacgttacgtcggtagcgtgaccactaacgttccttaag

SEQ ID NO: 331076 - DNA, 517 bp, Homo sapiens
  misc_feature: GZ8MTXP01ESX01.17.57.F02.1.454.CMB.2.raw
  modified_base (276)..(276): a, c, t, g, unknown or other
  misc_feature (276)..(276): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaatggatcagcggaaaccagggaaacncccctaaatcctgatctatactgacatccaattttgacaaagtgggtaccatcaaggttcagtggcagtgatctgggacagtatttcactctcaccatcagcagtctgcaactgagtatttagactaaactttacaacttgacaacgtagggtaacacgtaccccgtatactttggaccaggggaccaagtcttagggaanagacaacgaacgttgttgngtcgcacacttctcgttcgtc

SEQ ID NO: 331077 - DNA, 614 bp, Homo sapiens
  misc_feature: GZ8MTXP01EIKLM.17.57.F02.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (391)..(391): a, c, t, g, unknown or other
  misc_feature (391)..(391): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagatcacatctctggccggnaagtcagagcattagactaatttaaatggtatcgaggacggaaaccgagggaaacacccctaaactccagtatctatactgactatcctaatttgacaaaggtcgggtaccagtacgtagttcgagtggacaggtggatcgagggactagtacttcactctcactancagctagtctgacctaacgtgtaagttacgtttcgaacttaactttacctacgttacggtaacaaacggttacgggttaacctaaacccggtttaacccccgtagtttacccgtttcggggaacccgaaggggtaacccgagtcggttaacggaagtaacgttaacgaaacgaaccggttggttaacggccctaggacccttaaccctttcgttccgttaacg

SEQ ID NO: 331078 - DNA, 636 bp, Homo sapiens
  misc_feature: GZ8MTXP01EVMBJ.17.57.F02.1.454.CMB.2.raw
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctaccgcttaaaccgggacaaccgtcgcccggccaacatagccttctccgtcccccttcgcagtaacaccaagtacagaatattaacctgttcccatcgactacgccttcggcctcgccttaggggtcactcaccctgccccgattaacgtggacaggaacccttggtcttccggcgagccgggcttttcaccgtctttatcgttacttatgtcagcattcgcncttcngactacctccagcatcgcctcacgagcactaacccttcgaacaggccttaacaacgtaaacgccctaccccgtaacccaaacgaaaccacaactaaacgcgtcgctcgcccgcacgtccttcgggtacttccgaagttcgggtttaaaccgtccccccggtttttacaccgtttcccttccccggacctaacgttcgttacgttaccgttaacggttccgtaacg

SEQ ID NO: 331079 - DNA, 530 bp, Homo sapiens
  misc_feature: GZ8MTXP01DC94J.17.57.F02.1.454.CMB.2.raw
  modified_base (202)..(202): a, c, t, g, unknown or other
  misc_feature (202)..(202): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatctctgccgggcaagtcagagcattagactaaactttaaatggtatcgagcgggaaccagggaacacccctaaactcctgatctatactgcataccaatttgacaaagtcgggtaccatacgaagttcagtggacagtggatcgtagggacagtattcactctcaccatcagcagtctgacaactgagtatttgactaacttactatgtacaacgtagggttacaacgtaccccgtatacgtttcggccgtaagggaaccaaggtcttaggaaacgacttacgaaacgactggtagctgacttacctaattcgttcg

SEQ ID NO: 331080 - DNA, 557 bp, Homo sapiens
  misc_feature: GZ8MTXP01CLP5S.17.57.F02.1.454.CMB.2.raw
  modified_base (273)..(273): a, c, t, g, unknown or other
  misc_feature (273)..(273): n is a, c, g, or t
  modified_base (369)..(369): a, c, t, g, unknown or other
  misc_feature (369)..(369): n is a, c, g, or t
  modified_base (501)..(501): a, c, t, g, unknown or other
  misc_feature (501)..(501): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggatcagcggaaacagggaaacncccctaaatcctagatctatactgactatacccaaattttgacaaaaggttcggggtacccagtactaaaggttcaaggtggcaaggtcgaatcgngggacagtactttcactctacaccatcagcagtctgactacctgagtatttcgactaacttactacttgtactaacgtaggtaccacgtacccgtactacgtttcggaccgagggaccaaagcgttaggganactaacgaaacgttacgttggttacggctcgcctaccattccgtcgttctttaacc

SEQ ID NO: 331081 - DNA, 574 bp, Homo sapiens
  misc_feature: GZ8MTXP01BPJIQ.17.57.F02.1.454.CMB.2.raw
  modified_base (440)..(440): a, c, t, g, unknown or other
  misc_feature (440)..(440): n is a, c, g, or t
  modified_base (506)..(506): a, c, t, g, unknown or other
  misc_feature (506)..(506): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggcaacatagccttctccgtccccccttcgcagtaacaccaagtacaggaatataacctgttcccatcgactacgcctttcggcctcgccttagggtcgactcaccctgccccgattaacgttggacacggacccttggtcttccggcgagcgggcttttcgacccgtctttactcgttacttatgtcagcattccgctcttctgactacctcagcatcgcctcacngcacaccttcacaggcttacagaaccgcctacccctaccaacaacgcaataacgcgtcgctgcccncacgcttcggtgctacttggtttacgccccgttcttcactccttcccgctatccttgtaacttcgtcc

SEQ ID NO: 331082 - DNA, 629 bp, Homo sapiens
  misc_feature: GZ8MTXP01BUYRA.17.57.F02.1.454.CMB.2.raw
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (536)..(536): a, c, t, g, unknown or other
  misc_feature (536)..(536): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttgcagtaacaccaagtacaggaatattaacctgtttcccatcgactacgccttcggcctcgcttagggtcactcaccctgccccgattaacgtggacaggaacccttggtcttccggcgagcggtctttcaccgtctttatcgttacttatgtcagctaattcgntacttcngactaccctcagcatcgcctcacacgccacctaccttcaactacggaccttaacaacgtaacccgtcccgtaccccctaacccaaaccaaaccgccaacgtaacgccgtaccgcctcggcccncgtacgccgttcgggttgtccttagttcggtttacgttccccgttttcaccgttcccttccccgctactccttacgtaaccgttcggttaacc

SEQ ID NO: 331083 - DNA, 539 bp, Homo sapiens
  misc_feature: GZ8MTXP01ALNWC.17.57.F02.1.454.CMB.2.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggnaagtcagagcattagctaaactttaaatggtatcgagcgggaaaccagggaaacncccctaaactcctagatctatactgacatcctaatttgactaaaggtcgggtaccatcgaaggttcagtggacagtggatcgtgggacagtatttcactctacaccatcagcagtctgactactgagtatttcgactaacttactactgtacaacgtaggttacacgtaccccgtatacgtttcggccgtaagggaccaagcgttagggaactacttacgaaacgttacgtggtacggctgaccacctaattccgttcg

SEQ ID NO: 331084 - DNA, 548 bp, Homo sapiens
  misc_feature: GZ8MTXP01CR0ZZ.17.57.F02.1.454.CMB.2.raw
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (529)..(529): a, c, t, g, unknown or other
  misc_feature (529)..(529): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatcgacccagtcctccatcctccctgtctgcatctgtagagacagatcaccatctctgccgggcaagtcagagcattacgacttaaacttttaatggatcgaggacggaaaccagggaaacacccctaaagtccagtactctatactgactactactaatttgactaaaggtcgggtaccagtacgtaagttcaggtgcagtaggatcgtgggactagtattcactntacactancancnctactacgactactagtagtattagtactacttacgtactacgtacgtacgtaacgtacgtaccgtaccgtacgtacgttacgtacgacggacgaacgtacgagagacgtaacgaacgacgttcgcgtcncgcactacttctcgttctc

SEQ ID NO: 331085 - DNA, 594 bp, Homo sapiens
  misc_feature: GZ8MTXP01BQ519.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatctcttgccgggnaagtcagagcattagactaaactttttaaatggtatcaggacgggaaaccgaagggaaacgaccccctaaactcctagactctaatactgactactacctaatttcgacgtaaaggtcgggtaccagtacgtaaggttcgagtggcaggtgatcgtgggactagtacttcactctacacctatcagctagtctacgactaacgtggacgttatttcgacttaacttactacgttacgtaacaaacgtacgggttaaccacccggttaaccccgtataccgtttcgggaccaacgggggacaacggtcgttagggaacacgtaacgaaacgttacgttgacggtctcgaaccactagttctcgttcgttcc

SEQ ID NO: 331086 - DNA, 634 bp, Homo sapiens
  misc_feature: GZ8MTXP01BU7E0.17.57.F02.1.454.CMB.2.raw
  modified_base (231)..(231): a, c, t, g, unknown or other
  misc_feature (231)..(231): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcacatctctgccggacaagtcagancattagacttaaacttttaaatggatcgaggaccgggaaaccagggaaacacccctaaatcctagatactatactgactactacctaatttgacgtaaaggtcgggtaccagtacgtaaggttcagtggactagtaggatcgtagggacagtacttcactctacaccatcagtcagtctacgactaaccgtggaaggttactttacgacttaaacctttactacgttagtaacctaaacggttacgggttaacctacgttaaccccgttaacgttacgtttcggacccggtaacggggaaccctaaggtcgttagggaaacgttaaacgtaaaccggaaaacgttaccgttggttacggtaaccttacgaacctaacctattccgttaacgttccgtttaacc

SEQ ID NO: 331087 - DNA, 593 bp, Homo sapiens
  misc_feature: GZ8MTXP01CDLJ4.17.57.F02.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (563)..(563): a, c, t, g, unknown or other
  misc_feature (563)..(563): n is a, c, g, or t
  modified_base (579)..(579): a, c, t, g, unknown or other
  misc_feature (579)..(579): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttggccggnaagtcagagcattagactaactttaaatggtatcgaggcgggaaaccagggaaacgcccctaaactcctagactctatactgactatacctaagtttcgactaaaggttcggggtacccctagtacctaaaggtttcaaggttggacctaagggttggattcggtaggggtacaggtaatttccaacttcctactaaccaattcaaggtctacgttctacgcctaaaccgttgaaggttacttttcgacctaaactttacgtacttacgtactaacgtacgggttaactaccgtaccccgtagtacgtttcggccgtaagggaccagcgttgaacgnacgaaagactgagtcngccactaattctcg

SEQ ID NO: 331088 - DNA, 565 bp, Homo sapiens
  misc_feature: GZ8MTXP01D4LCM.17.57.F02.1.454.CMB.2.raw
  modified_base (233)..(233): a, c, t, g, unknown or other
  misc_feature (233)..(233): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggcaagtcagancattagacttaattttaaatggatcgagacgggaaaccagggaaacgcccctaaactcctagatctatactgactatcctaatttgactaaaggttcgggtacccatacgtaaggttcaggtggctaggtagatcgtagggactagtactttcactctacacatcagcagtctagcaactgagttatttcgacttaacttactactgtacaacgtacggttacacgttacccgtacttacgtttcgggaccgtaggggaacctaaggtccgttagggaaacttactaacgaaacgacgttgttaggctggcctactacttctcgttcttaac

SEQ ID NO: 331089 - DNA, 547 bp, Homo sapiens
  misc_feature: GZ8MTXP01AGMXJ.17.57.F02.1.454.CMB.2.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
  modified_base (536)..(536): a, c, t, g, unknown or other
  misc_feature (536)..(536): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggcaagtcagancattagctaacttttaatggatcagcggaacagggaaacncccctaaactcctgatctatactgcatcctaatttgacaaaggtcgggtcccagtacgaacggtttcaggtggcaggtacggatcgtagggacagtatttcactctcaccatcagcagtctacgacctaacgtgaaggttatttcgacttaacttactactgtacaacgtaggttaccacgttacccgtatacgtttcggaccgtacggggaccaagcgttagggaacactacgaaacgttacgttggttacggctagccaacctnttctcgttctc

SEQ ID NO: 331090 - DNA, 526 bp, Homo sapiens
  misc_feature: GZ8MTXP01D7VA3.17.57.F02.1.454.CMB.2.raw
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatctcttgccggnaagtcagagcattagctaactttaaatggtatcagcgggaaccagggaaacncccctaaatcctgatctatactgcatccaatttgacaaagtcgggtaccatcaagttcagtgacagtggatcgtagggacagtattcactctcaccatcagctagtctgacaacctgagttatttcgctaaacttactactgtacaacgagggttacaaccgttacccgtactacgtttcgggacgtaacgggaccaagcgttaggagacttacgaaacgacgtgtaggctcgacacctgttcgttaacg

SEQ ID NO: 331091 - DNA, 586 bp, Homo sapiens
  misc_feature: GZ8MTXP01DFUTM.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctctgccggnaagtcagagcattagctaactttaaatggtatcagacgggaaaccagggaaacgcccctaaactcctagatctatactgctacttaccaatttgacgtaaaggtcggggtacccctagtacgtaaggttcaggtggactaggtggatcgtagggactagtattcactctacactatcagcagtctgactaactgacgtatttcgacttaacttactactcgtacaaacgtagggttaccaacgttacccgtacgtcgtttacgggccgtaacggggaccaaggtccgttagggtaactacgttaaaccgaacggttaacgttggtacggcttacggaccttaccgtaacttcgtttaaccg

SEQ ID NO: 331092 - DNA, 597 bp, Homo sapiens
  misc_feature: GZ8MTXP01ALP3L.17.57.F02.1.454.CMB.2.raw
  modified_base (282)..(282): a, c, t, g, unknown or other
  misc_feature (282)..(282): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccggcaagtcagagctattagacttaaactttaatggtatcgaggacggaaaccagggaaacncccctaaatcctagatctatactgacatacctaagtttgaacgtaaaggtcggggtacccaagtacgtaaggttcaggtcggaactaggtggaacttcggtagggaactagttactttacaccttactccaacctatacgagctaacgtctacgacctaacgtgtaacggtattttcgaacttaacttacgtactacgtacaacgtacggttaaccacgtacccgttactacgttcggccgtaagggacagtcgaggaagtaacgttacgaaacgttacctggcgtaacgtcgacttacctaacttcgttaaccg

SEQ ID NO: 331093 - DNA, 584 bp, Homo sapiens
  misc_feature: GZ8MTXP01C9CX6.17.57.F02.1.454.CMB.2.raw
  modified_base (230)..(230): a, c, t, g, unknown or other
  misc_feature (230)..(230): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (536)..(536): a, c, t, g, unknown or other
  misc_feature (536)..(536): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacctatctcgttggccggganaagtcagagctattagacttaaactttaaatggtatcgaggacgggaaaccaagggaaacacccctaaactcctagatctatactgctactaccaagtttgacgtaaaggtcgggtacccaagtacgtaaaggttcaggtgaacgtagtggatcgtagggacagtacttcactctacacntcancagtctgactacgtagagttactttcgaacttaaccttacgtaacttcgtaacctaaacgtacgggttaccaaccgttacccgtattacgttcggacggaagggtaaccaggtcgaggtaanacttaacgaaacgttacgttggagtctagccttactcgttcgttaacg

SEQ ID NO: 331094 - DNA, 632 bp, Homo sapiens
  misc_feature: GZ8MTXP01EX9R7.17.57.F02.1.454.CMB.2.raw
  modified_base (410)..(410): a, c, t, g, unknown or other
  misc_feature (410)..(410): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatctcgttggccgggacaagtcagagctattagacttaactttaatggtatcgaggacggaacagggaaacacccctaaactcctagatctatactgacacttacctaatttgacgtaaaggtcggggtacctagtcgtaaggttcaggtaggacgtagtggatcgtagggactagtactttcactctacacatcanctacgtctcgaccaaacgttgtaaggttatttacgacctaaactttactacgttacgtaccgtaaacgtacgggtttaacctaccggttaaccccgttacgttaaccggttttcggaccgggtaaacgggtaccgttaaaggccgttaaggacgtaaacttaccgttaaaacggttaaccgttgggtaccggtaactcggaccttaacctcgtttcgttccg

SEQ ID NO: 331095 - DNA, 612 bp, Homo sapiens
  misc_feature: GZ8MTXP01AJISF.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (594)..(594): a, c, t, g, unknown or other
  misc_feature (594)..(594): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctcttgccgggnaagtcagagcattagacttaaactttttaaatggtatcgaggaccgggaaaccagggaaacnccccttaaactcctagactctatactgcatctaatttgactaaagtcgggtacccatcgaacgttcagtggcaggtgatcgtgggacagtactttcactctacacatcagcagtctacgactaaccgtgaggttatttcgactaacgtttactacgttagtacctaaacgttacgggttaacctacggttaacccccgttacttaccgtttccgggaccgtaacgggggaaccctaaaggccgttaaggggacgttaactaacccgtaaaacgttacgttggttacggtcttcggaacctaacccgttnttccgttcgttccgttcg

SEQ ID NO: 331096 - DNA, 619 bp, Homo sapiens
  misc_feature: GZ8MTXP01AGI6V.17.57.F02.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctggtagganacagagtcaccattctcgttggccgggnaagtcagagctattagacttaaacttttaatggtatacgaggaccgggaacaagggaaacctacccctaaactcctagactactatactgactattacctaagtttcgacgtaaaggttcgggtaccctagtacgtaacggttcaggtggctaggtgtatcgtagggactagtcttcactctacacctatacagctagtctacgacctaacgtgtacgttatttcgacttaaacgttactactagttacgaaacgttaggttaaccaccggttacccttacgtaccgtttcgggaccgtacggtaccaagtcgttaggtaacgaacgttaaaccgaaacgttccgttgggttcgaacgtacgaactaccgtattcgttcgttaaccttccg

SEQ ID NO: 331097 - DNA, 548 bp, Homo sapiens
  misc_feature: GZ8MTXP01DJS3I.17.57.F02.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
tcagcgtagactagcacgaccggtgctcgatttagctcgatatagttgggtttgggggcaggagtcagtctcagtcaggacacagcatggacatgagggtccccgctcagctcctgggggtcctgctactctggctccgaggtgccagatgtgacatccagatgacccagtctccatcctccctgtctgcatctgtagganacagagtcaccatctctggccgggcaagtcagagcattagactaaactttttaaatggtatcaggacggaaccaggaaacncccctaaatcctgatctanactgacatcctaattcgactaaagtcgggtcccatccgaaggttcagtggctaaggtggntcgtagggactagtactttcactctacaccatcagcagtctgactaactgtagtatttcgactaacttactactgtacaacgtaggttacaccgtaacccgtactacgtttcggccgtaagggaaccaagcgtaggagtacgtacaaaacgttcaggtggactcgaccacttacgtcttcgttaacc

SEQ ID NO: 331098 - DNA, 569 bp, Homo sapiens
  misc_feature: GZ8MTXP01AE294.17.57.F02.1.454.CMB.2.raw
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (467)..(467): a, c, t, g, unknown or other
  misc_feature (467)..(467): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccgaccaacatagccttctccgtccccccttgcagtaacaccaagtacaggaatattaacctgttccatcgactacgcctttcggcctcgccttagggtcactcaccctgccccgattacgtggacaggaacccttggcttccggcgagcgggtcttttcacccgntttatcgttacttancgtnagcattcgcncttctgatacctccagcatcgcccanacncncactacctcacgcgtactacgaacgtaccnccctaccccgaacaacgaccactagacgcgcgcncgccacgctcgttcggnactgttcgtaccgtcccttcgcttcctcccatctcgtcttacgtcttcgcg

SEQ ID NO: 331099 - DNA, 587 bp, Homo sapiens
  misc_feature: GZ8MTXP01AI6B4.17.57.F02.1.454.CMB.2.raw
  modified_base (385)..(385): a, c, t, g, unknown or other
  misc_feature (385)..(385): n is a, c, g, or t
  modified_base (523)..(523): a, c, t, g, unknown or other
  misc_feature (523)..(523): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttggacaggaacccttggtcttccggcgagcgggtcttttcacccgtntttatcgttacttatgtcagcattccgcaacttctgataccctcagcatgcctcacagccacaccttcacacggcttacgacgaacgcctacccctaaccaacaacgcaataacgcgtacgctcgccgcacgctcggnctagttcggtttaccgccccgtttcgcttcccgttcccgcctaatctcgactaagttctaaccg

SEQ ID NO: 331100 - DNA, 541 bp, Homo sapiens
  misc_feature: GZ8MTXP01CAK4J.17.57.F02.1.454.CMB.2.raw
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccggcaagtcagagcattagctaaactttaaatggtatcagcgggaaaccagggaaacncccctaaactcctgatctatactgcatccaatttgacaaaggtcgggtacccatcgaaggttcagtggactagtggatcgtagggacagtactttcactctcaccatcagcagtctagcaacgtgagtatttgactaacgtttactactgtacaacgtacggttacacgtacccgttatacgtttcggccgtaagggaccaaggcgttagggatacgttacgaacgacgtggtagcttggaccacctaacgttctttaacg

SEQ ID NO: 331101 - DNA, 566 bp, Homo sapiens
  misc_feature: GZ8MTXP01ELT4J.17.57.F02.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (384)..(384): a, c, t, g, unknown or other
  misc_feature (384)..(384): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaganacagagtcaccatctcttgccgggnaagtcagagcattagactaatttaaatgtatcgaagaccgggaaccaaggaaacgacccctaaactcctagatctatactgtacacttacctaatttcgactaaaggtcggggtaccctatacgtaaaggttcagtggacagtggatcgaggactagtnttcactctcacatcagcagtctagacaacgtgaggttatttcacttaacttacttatcggtaactaacgtacggttacaaccgttacccgtacttacgttcggcgtaacgggacttagcgttaggaacgtattaacccgaaagaccgttgacggtcttacggaccaacttcgttcgtttccg

SEQ ID NO: 331102 - DNA, 512 bp, Homo sapiens
  misc_feature: GZ8MTXP01A0MCW.17.57.F02.1.454.CMB.2.raw
  modified_base (507)..(507): a, c, t, g, unknown or other
  misc_feature (507)..(507): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaactttaaatggtatcaggcgggaaaccagggaaacgcccctaaactcctagatctatactgcactccaatttgacaaagtcggggtcccatcaaggttcaggtgacagtcggatcgtagggacagtatttcactctacactatcgagcagtctgaccacgttgaggtatttgactaacttactatagtacaacgtcggtacacgtacccgtatcgttgccgaagggacagcgttagagattacgaacgactgagctagcactnttgtc

SEQ ID NO: 331103 - DNA, 637 bp, Homo sapiens
  misc_feature: GZ8MTXP01CBSSS.17.57.F02.1.454.CMB.2.raw
  modified_base (200)..(200): a, c, t, g, unknown or other
  misc_feature (200)..(200): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctctgccgggcaagtcagagctattagacttaaattttaatggtatcgaggaccgggaaaccaagggaaacacccctaaactcctagatctatactgacatacctaatttgacgtaaaggtcgggtaccctagtacgtaacggttcgagtggactaggtaggatcgtgggaactagtacttcactctacacctatcagctagtctagacctaacgtggtagttacttttacgacttaaacctttacgtaacgttacgtaacctaaacggttacgggttaacctaccggttaaccccgttaacttacgtttacggacccggtaacggggacccaaaggtcgttaggtaacgttacgtaaaccgaaacgttaaccgttggttacggtaacctcgaaccctaactacttcttaacgttctttaaccg

SEQ ID NO: 331104 - DNA, 645 bp, Homo sapiens
  misc_feature: GZ8MTXP01BI6AP.17.57.F02.1.454.CMB.2.raw
  modified_base (198)..(198): a, c, t, g, unknown or other
  misc_feature (198)..(198): n is a, c, g, or t
  modified_base (438)..(438): a, c, t, g, unknown or other
  misc_feature (438)..(438): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatcctccctgtctgcatctgtaganacagagtcacatctctgccgggacaagtcagagctattagacttaaacttttaatggtatacgacggacgggaaaccgaagggaaaccgtacccctaaactcctagtactactaatactacgactattaccctaatttcggaacgtaaacgggttccgggtaccctagtacgtaaacggttcgaggtggacgtaggtaggactcggtagggaactagtactttcactctacactatacancgtatcgacgactaacgttgtaaggttattacgacttaaacgttactacgttacgtaaccgtaacggtacggttaaccaccgtttaccccgtacgttacgtttccggggaccgtaacgggaaccgtaagtacgacgggtaagttaacaaacggtaaacgttacggttggcggtaactacgaacctaaccttcttcgttccttcgtcg

SEQ ID NO: 331105 - DNA, 542 bp, Homo sapiens
  misc_feature: GZ8MTXP01CUZQB.17.57.F02.1.454.CMB.2.raw
  modified_base (277)..(277): a, c, t, g, unknown or other
  misc_feature (277)..(277): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaactttaatggtatcagcgggaacagggaaacncccctaaatcctgatctatactgcatccaatttgacaaagtcgggtacccatcaaggttcagtggcagtggatcgtgggacagtatttcactctacaccatcagcagtctagcaactgagtatttcgactaacttactactgtacaacgtagggttaccacgttaccccgtattacgttttcgggcccgtaaggggtacccaaggtccttagggaacgtattaaccgaacgttacgtggtcggctcgaccactaacttcgtttcg

SEQ ID NO: 331106 - DNA, 567 bp, Homo sapiens
  misc_feature: GZ8MTXP01DIF7I.17.57.F02.1.454.CMB.2.raw
  modified_base (198)..(198): a, c, t, g, unknown or other
  misc_feature (198)..(198): n is a, c, g, or t
  modified_base (435)..(435): a, c, t, g, unknown or other
  misc_feature (435)..(435): n is a, c, g, or t
  modified_base (519)..(519): a, c, t, g, unknown or other
  misc_feature (519)..(519): n is a, c, g, or t
  modified_base (556)..(556): a, c, t, g, unknown or other
  misc_feature (556)..(556): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagctattagactaaacttttaatggtatcgaggacgggaaaccaagggaaacgcccctaaactcctagatctatactgactatacctaatttcgacgtaaaggtcggggtaccctaagtccgtaaaggttcaggtggcaggtaggatcgtagggaactagtactttcactcacaccatcaagcagtctagactaactggaagttntttacgactaaacttactactagtacaaacgtaggttacacgtacccgtatcgtttggaccgtaggggaccaaggcttaggganacgtaacgaaacgttacgttgacggctagccaacctnttctcgttctc

SEQ ID NO: 331107 - DNA, 821 bp, Homo sapiens
  misc_feature: GZ8MTXP01C60EG.17.57.F02.1.454.CMB.2.raw
  modified_base (200)..(200): a, c, t, g, unknown or other
  misc_feature (200)..(200): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtccaccatctcttggccgggcaagtcagagacattagacttaaactttttaaatggtatacgacggaccgggaaaccgaagggaaacgtaccccctaaactcctagtacttacttaatacgtacgactaactaccctaaagtttttacgaacggtaaaacgggttcgggggttacccccaagttaccggtaaacgggtttccgaaggggttagggaccgtaaggttacgggtaaactttcgggttaacgggggtaaacctaaggttaaccttttaccctaaacctttcctaccctaaccctaattaccgacggtacctacggttaccctacggtaaccttaaacccgttgggtaacggtttaacttttacggaaacctttaaacccgttttaaccgttaacgtttacggttaaaccgtaaaccggtttaacggggtttaacccctaacccggtttaacccccggttaaccgtttaaccgggttttacccgggacccgggtaaaccgggggtaacccgtaaacggtccggttaagggaaacgttacgtaaaccgtaaacggttaacgttggttaacggtcctacgccctactacgtttcctcggttaacctttccg

SEQ ID NO: 331108 - DNA, 546 bp, Homo sapiens
  misc_feature: GZ8MTXP01CVICL.17.57.F02.1.454.CMB.2.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (522)..(522): a, c, t, g, unknown or other
  misc_feature (522)..(522): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctctgccgggnaagtcagagcattagctaattttaatggatcagacggaaccagggaaacncccctaaatcctgatctatactgcatcctaatttgacgtaaagttggggaccctagtacgaacggtttcagtggacaggtggatcgtgggacagtatttccactctcactatcagcagtctacgactaacctgaggttatttcgactaacttactactacgtactaacgtacggttacacgttacccgtacgtcgtttcggaccgtacggggactaaggcgttaggagacgtaacgaacgaacgttggcgntcgcacgtattctcgttcttaacc

SEQ ID NO: 331109 - DNA, 567 bp, Homo sapiens
  misc_feature: GZ8MTXP01AW8KZ.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagacttaaactttaaatggtatcgaggacgggaaaccagggaaactcccctaaactcctagactctatactgacatacctaatttgacgtaaaggtcggggtaccctagtacgtaaaggttcaggtggaacaggtggatcgtagggactagtattcactctacaccatcagctagtctgacaacgtgtagtatttacgactaacttactactagtaccaacgtaggttaccacggtaccctactacgtttcggacgtaacgggaccaaggtcttagggaatacttacgaaacgttacgtggtcgaacgtcgaccttactaacttctcg

SEQ ID NO: 331110 - DNA, 640 bp, Homo sapiens
  misc_feature: GZ8MTXP01CBF0M.17.57.F02.1.454.CMB.2.raw
  modified_base (548)..(548): a, c, t, g, unknown or other
  misc_feature (548)..(548): n is a, c, g, or t
  modified_base (593)..(593): a, c, t, g, unknown or other
  misc_feature (593)..(593): n is a, c, g, or t
tcagcgtagactagcacgaccggtgctcgatttagctcgatatagttgggtttggggtacgatttgatgttacctgatgcttagaggcttttcctggaagcagggcattttgttgcttcagcaccgtagtgcctcgtcatcacgcctcagccttgattttccggatttgcctaggaaaaccagcctacccgcttaaaccgggacaaccgtcgcccggccaacatacgccttcctcccgtccccccttgcagtaacaccaagtacaggaatattaacctgttccatcgactacgccttcggcctcgccttagggcactcaccctgccccgattaacgtgacacggtaccttggtcttccggcgagcgggtcttttccgaccgtctttatcgttacttatgtcagctattccgctaacttctgacttaccctcagtcatcgacctcaacacgcctaacaccttcaactacgtacttaacgaacgtaaccgcccttaccccgtaacccaaaccaaaccgacaaagtaacgccgtacgccgtcgcccgtacncgtcgttcggtcgcttaacgttcgggtttaaccgtccccgtttcnccgttcccttccccgctaacgttcctagttactaacggttctaacgg

SEQ ID NO: 331111 - DNA, 685 bp, Homo sapiens
  misc_feature: GZ8MTXP01B4TQH.17.57.F02.1.454.CMB.2.raw
  modified_base (273)..(273): a, c, t, g, unknown or other
  misc_feature (273)..(273): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaatggtatcagcgggaaccagggaacncccctaaatcctgatctatactgactatcctaatttgacgtaaaggttcggggtacccaagttcgtaacggtttcaggttcggactaggttagggattcggtaggggtaacctaggtacttttaccacttcctaccaaccctatacgaacggctaacggttcctacggaccctaaaccgttgggtaacgggttactttttacggaaccttaaaccgttttacgtaaccgttaggttaacccaaacgggttacggggtttaacccaaccggtttaacccccgttaacgttaccggtttttcggggaccccggttaagggggaaccccaaagggtccgttagggaaacgttacgttaaaccgaaacgttacgttggttcggcttcgaaccacctattccttcggttccttaacc

SEQ ID NO: 331112 - DNA, 576 bp, Homo sapiens
  misc_feature: GZ8MTXP01A6ODE.17.57.F02.1.454.CMB.2.raw
  modified_base (535)..(535): a, c, t, g, unknown or other
  misc_feature (535)..(535): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagctattagtacttaaactttttaaatggtatcgaggaccgggaaccgaagggaaacgacccctaaactcctagtatactatactgacactcctaatttgacgtaaaggtcgggtaccctagtacgtaacggttcaggtggactaggtagacgtcgtagggactagtactttacactctacacatcagctacgtctacgactaaccgtggagttatttacgacttaaccttacgtactacgtacaaacgtacgggttacctacgtaccccgtattcgttcggaccgacgggacaagcgttagganatacgaaagcgttggagtcngccnctattctcgttctaacc

SEQ ID NO: 331113 - DNA, 540 bp, Homo sapiens
  misc_feature: GZ8MTXP01C15JE.17.57.F02.1.454.CMB.2.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
  modified_base (404)..(404): a, c, t, g, unknown or other
  misc_feature (404)..(404): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggnaagtcagagcattagactaaactttaatggtatcaggacggaaaccagggaaacncccctaaactcctagatctatactgctatccaatttgacaaaggtcgggaccctagtacgaaggttcaggtgacgtagtggatcgtagggactagtactttcactctcactagtcagcagtctnacactgagtatttgacttaactactactcgtacaagtaggttaccacgtacccgtatacgtttcggccgtaagggacaaggtcgaggaagacttacgaacgttacgttgacggtcagccttaccgtaattccgttg

SEQ ID NO: 331114 - DNA, 583 bp, Homo sapiens
  misc_feature: GZ8MTXP01BBTJN.17.57.F02.1.454.CMB.2.raw
  modified_base (275)..(275): a, c, t, g, unknown or other
  misc_feature (275)..(275): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggatcagcgggaacagggaaacncccctaaatcctagatctatactgactatacctaatttgacaaaggtcgggtaccatcgaaggttcaggtggcaggtggatcgtagggacagtactttcactctacacctatcagcagtctagacctaactgaggttatttagactaacttactactgtaccaaacgtacgggttaccaccgttaccccgttaactacgtttcgggaccgaacgggggtaccaaggtcgttaggggaacttacgtaaaccgaaaacgttacgttggttacggtcctcggaacctacctacttccgtcgttcttaaccg

SEQ ID NO: 331115 - DNA, 557 bp, Homo sapiens
  misc_feature: GZ8MTXP01BP106.17.57.F02.1.454.CMB.2.raw
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttggccgggnaagtcagagcattagctaaatttttaaatggtatcaggacgggaaaccaggggaaacncccctaaactcctagactctaatactgactatcctaaattttcgactaaaagtcggggtacccagttcgaaacggttcaggtggtcaggttggactcgtaggggaccagtactttccactctcaccatcagcagtctgactaactgtagtatttgactacttactactgtacaacgtaggtactacgtacccgtactactttggaccgtaggaccaagcttaggagataacgaacgagttcgttcgtctcgcctactattccgttgttccttcc

SEQ ID NO: 331116 - DNA, 579 bp, Homo sapiens
  misc_feature: GZ8MTXP01CQXKQ.17.57.F02.1.454.CMB.2.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (414)..(414): a, c, t, g, unknown or other
  misc_feature (414)..(414): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcgttgccgggnaagtcagagctattagacttaaactttaaatggtatcgaggaccgggaaaccaggggaaaccncccctaaactcctagactctatactgacactacctaagtttgacgtaaaggtcgggtaccagtacgaaggttcaggtggacgtagtgatcgtagggacagtactttcactctacaccatcagnacgttctgaccaacctaggacggttatttcgacttaactttactactcgtacaacgtaggttacaaccgtcccgtaagtcgttacggccggtaagggacccaagtccgttaggaacgtattaccgaaacggttacttggacgtcgtcgaccacgtaattcgttcg

SEQ ID NO: 331117 - DNA, 606 bp, Homo sapiens
  misc_feature: GZ8MTXP01CNCHN.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacctatctctggccggnaagtcagagctattagacttaaactttaatggtatcgaggacgggaaaccagggaaactacccctaaatcctagatctactactgactattccaaagtttcgacgtaaaggtcggggtacccaagttacgtaaggttcaaggtcggaacaggtggactcgtagggacagtatttcactctacacatacagcgaacgtctacgactaaccgtgtaaggttactttacgaccgttaacttaactactacgtactaacgtacggtactaccgtacccgtacgtacgtttcggcgtaacgggaacaggtcgttaggaacgtacgttaaccgaaaacgttcgtggtacggtcgtacggaccgttaccgtaacttcggtttaaccg

SEQ ID NO: 331118 - DNA, 574 bp, Homo sapiens
  misc_feature: GZ8MTXP01E2SYK.17.57.F02.1.454.CMB.2.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
  modified_base (412)..(412): a, c, t, g, unknown or other
  misc_feature (412)..(412): n is a, c, g, or t
  modified_base (560)..(560): a, c, t, g, unknown or other
  misc_feature (560)..(560): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctggtagganacagagtcaccatctcgttggcccggganaaaggtcaagagcattagactaaactttaaatggtatcaggacgggaaccaggaaacncccctaaactcctagatctatactgacatacctaagtttcgacaaaggtcggggtacccaagtacaaggttcaggtggacaggtggatgtagggacaggtacttcactctacaccatcagnagtctagcaactgtaagtatttagactaaacttactaactcgtacaacgtaacggttactaaccggtaccccgtacttacgtttacgggcccgaaggggaacccttaaaggcgttagggaataacgttacaaaacgacgtgacggctnacaccttgttcgtg

SEQ ID NO: 331119 - DNA, 656 bp, Homo sapiens
  misc_feature: GZ8MTXP01CYML3.17.57.F02.1.454.CMB.2.raw
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatctctgcggnaagtcagnctatanacttaatttaagtgangaggacggaacagggaaacacccctaatcctagactctatactgactactacctaagtttcgaacgtaaaggtcggtaccctagtacgtaacggttcgaggtcggactaggtacgtacgtcggtagggactaagttacttacactactacactactacgacgtctacgtctacggactacgtaggtaagttactttacaaccttaacttactaacgttacgtaaccgtaaacggtaacggttaacccacccggtttaacccgttaacgtttacgtttacccggggaaccggaacggggtaaccctaaggtccgttaagggtaacttaaccgttaaaccgaaacgttaaccggttggttacggaacctacgcctaaccgtctttccggttaacgttccctttaaccg

SEQ ID NO: 331120 - DNA, 605 bp, Homo sapiens
  misc_feature: GZ8MTXP01DCPLI.17.57.F02.1.454.CMB.2.raw
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
  modified_base (586)..(586): a, c, t, g, unknown or other
  misc_feature (586)..(586): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaaccatcacgttcggccgggnaagtcagagcattagcagcttaattaattggtatcagacaagaaccgagggaaacncccctaagctcctgacttctttgctgctactccgtagtttacgacccgtaaaggttcggggtacccttagaaggttcgaaggtggacgtagggtgactcgagggtactagtactttcactctacacctatacgagctagtcacgtaccaaccttagtaaggttacttttacgaaccttaactttaactacgttagtaccaaactacgtaacgttaccaaccttccccgtcgtcttccgtacgttcggggacggtaacgggaaccgttaggggttacgaaggtaactaaccgaaaacgggtnttcgggtaacggctaaccg

SEQ ID NO: 331121 - DNA, 576 bp, Homo sapiens
  misc_feature: GZ8MTXP01A5UPL.17.57.F02.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (478)..(478): a, c, t, g, unknown or other
  misc_feature (478)..(478): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtcctgcatctgtagganacagagtcaccatctctgccggnaagtcagagcattagctaaactttttaaatggatcgagcgggaaccagggaaacgcccctaaatcctgactctatactgacattccaattttgactaaaaggttcggggtacccagtccgtaaagggtttcaggttggctaggtacgggatcgtaggggaacagtactttcactctcaccgtatcagcagtctgctaaccgtgagtatttgactaacttacgtactgtacaacgtagggttaccacgtaccccgtanacgttttcggaccgtacggggactaacggcttaggggaaacttagtaaccgaaacgaacgttgttacggtctaggcctacacttcttcgttctttaac

SEQ ID NO: 331122 - DNA, 630 bp, Homo sapiens
  misc_feature: GZ8MTXP01DRF75.17.57.F02.1.454.CMB.2.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
  modified_base (412)..(412): a, c, t, g, unknown or other
  misc_feature (412)..(412): n is a, c, g, or t
tcagcgtagactagcacgaccggtgctcgatttagctcgatatagttgggtttgggggcaggagtcagtctcagtcaggacacagcatggacatggacgggtccccgctcagctccgtggggctcctgctactctggctccgaggtgccagatgtgacatccagatcgaccccagtcctccatccctccctgtctgcatctaggtaganacagatccacctatctcgtcggccggnaagtcagagcattagtactaaactttaatggtatcgaggacgggaaaccgaagggaaacncccctaaactcctagatactatactgactacttacctaagtttcgaacgtaaacggtcggggtacccattaccggtaaggttcaaggtggaactaggtggatcgtagggactagtnttacactctcactatcagctagtctagacacgtagtagttactttacgacttaacttacttaacgtacgtactaaacgttacgggttacctaaaccgttaccccgttacgttacgtttccggaacccggtaagggggaacccaaggtccgttagggaaactacgttaaacgaaacggttacgtggtacggtctcggaccttacctgttcgtttaaccg

SEQ ID NO: 331123 - DNA, 561 bp, Homo sapiens
  misc_feature: GZ8MTXP01ECYPK.17.57.F02.1.454.CMB.2.raw
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
  modified_base (542)..(542): a, c, t, g, unknown or other
  misc_feature (542)..(542): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtccccccttcgcagtaacaccaagtacaggaatattaacctgtttcccatcgactacgcctttcggcctcgcttaggggtcactcaccctgccccgattaacgtggacaggaacccttggtcttccggcgagcgggtcttttcgacccgtgtttactcgttaccttatgtcagcaattcgcacttctgactacctcagcatgcctcacagcacaccttcacagctacagacnctccccacaacacgcatagcgtcgctcgccgcagcttcggcncgttagtcggttacttccccgtttcactccttcccnctactcttgtaacgttgtc

SEQ ID NO: 331124 - DNA, 857 bp, Homo sapiens
  misc_feature: GZ8MTXP01BIJGA.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccactcctcctgtctgcatctggtagagacagagtcacatctctggccggcaagtcagagctattagacttaaacgtttaatggtaactcgaacggacgggaaaccaacgggtaaaccaccccgtaaactccgtagtactactaatactgactaacttacctaagtttcgaacgtaaacggtcggggtacccctaagtaccgtaaagggttccaaggtacgaacgtaaggttggaactacggtacggggtaactaacggttaactttaccaaaccgttaccttaccgaaccccgttaaacgtaccgtaacggtaaccgttaccggttaccgtaccggtaacccgttaaaccggttacggttaaacggtttaacgttttaacccgtaaacccgtttaaacccgtttaaacgttaaccgttaaccggttaaacccggttaaaccgggttaaaccgggtttaaacccggttaaacccccggttttaaacccccggttaaaccggttttaacccgggtttaacccggggaaacccgggttaaaccggggtaaacccgttaaacgggttaaccggttaacggggaaaacgttaacccggttaaaacccggttaaacggttaccgggttaacgggtaccgtaaccggtacccgtaaccgttaacccgttaacgtttaaccgtttaacccg

SEQ ID NO: 331125 - DNA, 654 bp, Homo sapiens
  misc_feature: GZ8MTXP01A5NA9.17.57.F02.1.454.CMB.2.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (407)..(407): a, c, t, g, unknown or other
  misc_feature (407)..(407): n is a, c, g, or t
tcagcgtagactagcacgaccggtgctcgatttagctcgatatagttggggtttgggggcaggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatctcgttggccggganaagtcagagctattagcttaaatttaatggtatcgaggacgggaacaggaacncccctaaatcctgactctatactgactatcctaaagtttgaactaaaggtcggggtaccctatacgtaaaggttcagtggaacagggtggatcggtgggacagtacttcactctcacatcagntaacgtcacgacctaacgtgtaggttacttttacgaacttaaacgttacttacgtagttaaccgaaacgttaacgggttaactaaccgggttaaccccgtaacgtttaaccggttttccggggaccggtaaacggggggtaacccaaagggtccgttaacgggtaaacgtaacgttaaacccgttaaaacgggttacttcggggttaccgggcttaccgggacttaacccgtaacttccgtttccgg

SEQ ID NO: 331126 - DNA, 673 bp, Homo sapiens
  misc_feature: GZ8MTXP01AZU6C.17.57.F02.1.454.CMB.2.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgctatctggtaggagacagatcaccatctcgtgccggnaagtcagagctattagacttaaactttaatgtatcgaggacggaaccaggaaacctacccctaaactctgactctactacgtnctatacctaattcgactaaggtcgggtacctagtacaaggttcaggtgacgtagtcggtatcggtagggaactaggttacttacctaactccctcgtaaccctagtcgacgacgttacggttacctgtaacccgtaaccgttaggtaaggtttacgttttaccggaaccgttaaacgtttaccttaacgtttacggtaaccgtaaacggtaacggggtttaacctaacccggttaaccccgttaagtaccggtttacgggaccgggtaacggggaacccttaggacggttacgggaaactacgttaacgttaaacgttacggttcggtcggtcctacggaccttaccctttcgttccgtcg

SEQ ID NO: 331127 - DNA, 653 bp, Homo sapiens
  misc_feature: GZ8MTXP01C79VZ.17.57.F02.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (314)..(314): a, c, t, g, unknown or other
  misc_feature (314)..(314): n is a, c, g, or t
  modified_base (366)..(366): a, c, t, g, unknown or other
  misc_feature (366)..(366): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatctcgtcgccgganaagtcagagctattagacttaaattttaatggtatcgaggaccggaaacgaagggaaacctacccctaaactcctagtactactatactnactactacctaatttacgaacgtaaaggtcggtaccatacgtaagtcagtgnaggtgatcgtaggatagtactcactctacacatcgacgtcacgttacacgaaccttaacgtggtaagtttacttacaaccttaaactttactaacgttacgtaaccgaaaccggttacggttaaacccgtacccgtttaacccgttaaccgttacggtttaccgggaacccggaacgggtaacgtaacggtcggttaacgggaaacttaaacgaaacccgtaaaacggttacgttcggttacggtctacgaacccgtaacttcgttacgttccgttcgtttaacccc

SEQ ID NO: 331128 - DNA, 606 bp, Homo sapiens
  misc_feature: GZ8MTXP01A23R5.17.57.F02.1.454.CMB.2.raw
  modified_base (571)..(571): a, c, t, g, unknown or other
  misc_feature (571)..(571): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcacatctcttgccgggacaagtcagagcattagcttaaacttttaatggtatcaggacgggaaaccaagggaaacacccctaaactcctagactctatactgactatacctaatttcgacgtaaaggtcgggtaccagtacgtaaggttcaggtgcgtagtagatcggtagggaactagtacttcactccacactagtacagtcgtacgtcgtacgactaacctggtacgttattacgactaacttacgtacttagtaaccaaggttacggtaaccaccgttaacccgtacgttacgttcggacccggtaagggaaccctaagtacggttaggtaacgagtaaacgaaaccgttagttggttaccgngttacgaaccactacgttcgtcgttccttaacccg

SEQ ID NO: 331129 - DNA, 549 bp, Homo sapiens
  misc_feature: GZ8MTXP01AWY6N.17.57.F02.1.454.CMB.2.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (408)..(408): a, c, t, g, unknown or other
  misc_feature (408)..(408): n is a, c, g, or t
  modified_base (500)..(500): a, c, t, g, unknown or other
  misc_feature (500)..(500): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatctctgccgganaagtcagncattagctaattttaaatggatcgagacggaacagggaacncccctaaactctgatctanactgcatcctaatttgacaaaggtcgggtaccagtacaaggttcagtggacaggtggactcgtagggactagtatttcactctacactatcgagctagtctagctactgagtactttnacttaacgttactactgtaccaacgtacgggttaacaccggttacccgtactaacgtttcggaccgtaggggaccaaggccgttagggaaanacgtaaacgaaacggttcgttgcgtctacgcactcttcgttcgttcgtc

SEQ ID NO: 331130 - DNA, 570 bp, Homo sapiens
  misc_feature: GZ8MTXP01COIXS.17.57.F02.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (406)..(406): a, c, t, g, unknown or other
  misc_feature (406)..(406): n is a, c, g, or t
  modified_base (410)..(411): a, c, t, g, unknown or other
  misc_feature (410)..(411): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatcctcctgtctgcatctggtagganacagagtcaccatctcttgccggganaagtcagagctattagacttaaactttttaaatggtatacgaggacgggaaaccgaagggaaacctacccctaaactcctagactctatactgactatacctaatttgacgtaaaggtcggtaccagtcgtaaggttcagtggactaggtgatcggtagggactagtcttcactcacgacntcannatctgactactagtagtattatactacttacgtactagtactaacgtacgtacgtaccgtaccgtacctacgttcgtacgacggacgaacgtacgaggacgagtaacgaacgaacgttgttcggtaacgtacgaactactacttacttcgttcgtttcc

SEQ ID NO: 331131 - DNA, 585 bp, Homo sapiens
  misc_feature: GZ8MTXP01EKNVC.17.57.F02.1.454.CMB.2.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggcaagtcagancattagactaattttaaatggtatcaggcaacgggggggganaaacgcccctaaatcctagactactatactgactatcctaatttgactaaaggtcgggtaccagtctaaaggttcgagtggacaggtaaggatcgtgggacagtactttcactctcaccatcagcagtctacactaaccgtgaggtactttgactaacttactatcgtaccaacgtacgggttaccaacgttacccctagttaccgtttagggacccgagggggaacctaaaggtccgttaggggaacttacgtaaaccgaaaacgttacgttggttacggcctagaacctacctattcgttgttctttaac

SEQ ID NO: 331132 - DNA, 626 bp, Homo sapiens
  misc_feature: GZ8MTXP01CX79S.17.57.F02.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatcgacccagtcctccatcctcctgtctgcatctgtagganacagagtcaccatctctgccgganaagtcagagctaattagactaactttttaaatggatcgagacgggaaaccagggaaacncccctaaactcctagatctatactgacactcctaagtttcgacgtaaaggtcggggtaccctagttacgtaaacggtttcaggttggactaggtagggattcggtaggggaactagtattcacttctacacctatcagtcacggttctagacctaaccgtggtagttacttttcgacttaaactttacgtacttacgtacctaaacgtacggttaacaccggttacccctattaccgtttcgggaccgtacggggtaccaaaggtcgttagggtaacttacgtaaacgtaacgttacggttcgttacgtccgtacgaacctactacgttcgttcgttcttaaccc

SEQ ID NO: 331133 - DNA, 646 bp, Homo sapiens
  misc_feature: GZ8MTXP01D4CLN.17.57.F02.1.454.CMB.2.raw
  modified_base (239)..(239): a, c, t, g, unknown or other
  misc_feature (239)..(239): n is a, c, g, or t
  modified_base (431)..(431): a, c, t, g, unknown or other
  misc_feature (431)..(431): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgaccccagtcctccactccctccctgtctgcatctaggtaggagacagagtccacctatctcgttcggccggganaagtcaagagctaattagacttaaatttaaagtggtatcgaaggaccgggaaaccgaaggaaaccgtacccctaaactcctagatctaatactgactactacctaagtttcgaacgtaaaggtcgggtaccctagtacgtaaggttcagtggacaggtggatcgtagggactagtacttcactctacactancagactacgtctacgactaaccgtaggtaagttatttacggaaccttaaacgtttacgtaacgttacgtaaccgaaacggttacgggttaacctaacccgttaacccgttaccttacggtttaccggaccgggtaaaccgggcgaaaggtcggttaacggaagtaaccgttaacgaaacggttactggagtcgtcgaccttacgtcttcgttccg

SEQ ID NO: 331134 - DNA, 645 bp, Homo sapiens
  misc_feature: GZ8MTXP01A9FYS.17.57.F02.1.454.CMB.2.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttggccgggacaagtcagagcattagactaaatttttaaatggatcaggcgggaaccagggaaacncccctaaancctgatctatactgcatccaatttgactaaaggtgggtcccagtcgaagttcagtggctagtgatcgtgggacagtatttcacttctaccacctatccagtcacgtctacgactaaccgtggtaaggttacttttacgaacctttaaaccgtttaccttaacgttacggtttaaccgaaacgttacggggtttaaacccaacggtttaacccccgttaacgttaccgtttttacggggcccgttaaacgggggacccaaagggtcccgttagggaattaccgttaaacgaaaacccggttaacgttggggttaaccgtcgtacgaacctaactacttaccgttcgtttaacccttcg

SEQ ID NO: 331135 - DNA, 583 bp, Homo sapiens
  misc_feature: GZ8MTXP01EH4YW.17.57.F02.1.454.CMB.2.raw
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (560)..(560): a, c, t, g, unknown or other
  misc_feature (560)..(560): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcacatctcttgccgggcaagtcagngctattagacttaaactttttaaatggtatcgaggacgggaaaccagggaaacncccctaaactcctagactctatactgactacttacctaaattttcgaactaaaggttcgggtaccctagtacgtaacggttcaggtggctaggtaggatcggtagggactagttactttcactctacaccatcagctagtctacgactaacgtgagttactttgactaactttacacgttcgtaacaacgtacggtacaccgttaccctaacttcgttacggcgtaacgggaccaaggtcgttaggacgttacaaacgaaacgacgttgttacgntcgcacctgttccttcgttctcg

SEQ ID NO: 331136 - DNA, 733 bp, Homo sapiens
  misc_feature: GZ8MTXP01EITS1.17.57.F02.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatctcttcggccgganaagtcaganactattagacttaaacttttaagtgtancgacggaccggaaacgagggaaacctacccctaaactcctagacttactaacttactcgtactacttaccgtaaagttttcggaacggtaaagggttcccggggtacctaagtacggttaaacggttcgtaaggtcggacgtagggtaaggacgttcggtagggtaaactacgtttactttaccaccttcttacccacctacttacgacgtacgtacggtctaccgacgtaaccgtaggtagttacttacgaactttaaccttacgtacgttacgttaaccgtaacgttaaccggttaacctacccggttaaccgttaccgttacggtttaccgggaccgggttaaccgggaacctaacggtcggttaacgggtaacgttaaacgtaaaccggtaaaacgacggtttcggacgggtaaccttaccggaacctaccgttacttccgttaaccgttttccgtttaaccccg

SEQ ID NO: 331137 - DNA, 520 bp, Homo sapiens
  misc_feature: GZ8MTXP01B6MZ9.17.57.F02.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctctgccggnaagtcagancattagactaacttttaatgatcagcggaacaggaaacncccctaaatcngatctatactgactatctaatttgactaaaggtcgggtaccatccgtaagtcagtgactaggtagatcgagggacagtactttcactctacacatcagcagtctagactactgagttactttgactaacttacgacttgtacaacgtaggttaccacgtaccccgttatcgtttcggccgaaggtaccaagcgttagacgttatacgaagacgttgagcttnctacctnttcgtcgttctc

SEQ ID NO: 331138 - DNA, 658 bp, Homo sapiens
  misc_feature: GZ8MTXP01CT5U3.17.57.F02.1.454.CMB.2.raw
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcctcttggccgggacaagtcaagagactattagtacttaaactttttaaagttggtaatacgaacggaccgggaaaccgaaggggaaacgacccctaaactccctagtactactatactgactactacctaagtttgaacgtaaaggttccgggtaccagtaccgtaaggttcgaaggtgactaggtacggatcggtagggactaagtactttaccacttctacaccatacgacgctacgtactacggacctaaaccgtgtaacggttactttacgacttaaacctttacttacgtacgtaaccgaaacgttacgggtaacctaccggttacccgtaacgttccgtttaccggacggtaacgggaacaaggtcgaggaacgttactaaacgaacgttacgttgggacgtctacgtaacctacctagttcgttcgttctttaaccg

SEQ ID NO: 331139 - DNA, 680 bp, Homo sapiens
  misc_feature: GZ8MTXP01BGGUB.17.57.F02.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcacatcctcgttggccggnaagtcagancattagcttaaacttttaatggtatcgaggaccgggaaaccgagggaaacctacccctaatcctgatactatactgactactactagtttagacgaaaggttcgggtaccactacgtacggttacgagtggactaggtagtagttcgtagggtacgtagttactttacctactcctacacccattccacgtacgtacgtcgtacgtactaaaccgttggtacggttactttacgtaacttaaccgtttacgttacgttacgtaaccgtaaaccgggttaacggttaacccctaccgttaacccccgttaacgtttccggtttaccgggaccggaaccggggttaacaaaggtccggttagggaaacttaacgtaaaccgtaaaacggttcgttgggttacgtaaccgttcgaacctaacggtcttacttccgttccgtttaaccg

SEQ ID NO: 331140 - DNA, 564 bp, Homo sapiens
  misc_feature: GZ8MTXP01BAGSH.17.57.F02.1.454.CMB.2.raw
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcgttgccggcaagtcagagcaattagactaaactttaatggtatcgaggacgggaacagggaaacacccctaaatctanactctatactgctatacctaatttcgaacgtaaaggttcggggtaccctaacgttacgtaaaggtttcgaggtcggaacgtaggtcggatcggtagggactagtactttcacttctacactatcagctagtctnactaaccgtgacgttatttcgacttaactactactcgtacaagtcggtactacgtaccctactacgtttcgcgtaacggaccagcgttacgaagacttaacgaacgacgtgtcgctcacactaacgttctaacg

SEQ ID NO: 331141 - DNA, 622 bp, Homo sapiens
  misc_feature: GZ8MTXP01BLCFT.17.57.F02.1.454.CMB.2.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (451)..(451): a, c, t, g, unknown or other
  misc_feature (451)..(451): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctggtagganacagagtcacatctcgtcggccgganaagtcagacgctaagttacgtacttaaactttaagtggtatacgaacggaccgggaaaccgaacgggtaaacctacccctaaactccgtagtacttacctaatactacgactaacttaccgtaagtttacgacgtaaaggtcggtaccctagtacgtaaaggttcaggtcgacgtagtggactacggagggactagttacttcacttcactacatcagtnacgtcacgacacgtgacgttattacgaacgtaacttagtactacgtaacaacggtacgtaacctaccgtacccgttacgtacgttacggcgtaacggacaggtcgttaggtaacgtacgttaacgaacgttaccgtggtacgtctacggaccttactaacttcgttaaccg

SEQ ID NO: 331142 - DNA, 582 bp, Homo sapiens
  misc_feature: GZ8MTXP01CW2VW.17.57.F02.1.454.CMB.2.raw
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
  modified_base (513)..(513): a, c, t, g, unknown or other
  misc_feature (513)..(513): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggnaagtcagagctattagactaaactttaaatggtatcaggacgggaaaccagggaaacncccctaaatcctagactctatactgctataccaagtttgactaaaggtcgggtaccctagtacgaaggttcaggtcggaactagggtgatcgtgggactagtactttcactctacaccatcagtcagtcctagaccaactgtaggtacttttcgacttaacttactactacgtacaacgtgggttacacgttaccctattacgttcggccgtaaggggaccagtccgngtaaacgtacgttaacgaaacggttacgttgggtacggtaaccttcggaccaaccttcgttccgttccg

SEQ ID NO: 331143 - DNA, 829 bp, Homo sapiens
  misc_feature: GZ8MTXP01CR48X.17.57.F02.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatctctgccgggnaagtcagagctattagactaaactttttaaatggtatcgaggcgggaaaccaagggaaacgaccccctaaatccctagactactatactgactactacctaaatttggacgtaaaggtcgggggtacccctaagtaccgtaaaacggtttcgaaggttcgggactaagggttagggaacgttcggtacggggtaaactaaggttacttttacccactttcctacccaaccctattaccgaaggtactacggttaccctaggtaaccctaaaccgttaggaagggtttaactttttcggaaaccttaaaacccgtttaaccgttaaaccgttacggttaaacccgtaaaaccgggttaacggggtttaaaccctaacccggggttttaaacccccccgttaacgtttaaccggggttttttaccgggacccccgggtaaaagggggtaaaccccgtaaaacgggtcggttaacggggtaaaccggttacttaaaacccgggaaaacggtttaaaacccgggttgggtttacccgggaaccgtttaacccgggaacccgttaacccgtaacgtttcccttttaaccggtttcccgttttaaaccccg

SEQ ID NO: 331144 - DNA, 638 bp, Homo sapiens
  misc_feature: GZ8MTXP01BRVW7.17.57.F02.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctcttgccgggnaagtcagagctattagcagtacttaattaaattggtatcaagacaaacgaaaccgaggaacgcccctaagctacctntatctttgctgctatccgtagtttgacgtaacggttccggggttacccttagaaggttcaggttcggactaaggtggtactcggtagggtaacctagttacttccaccttctacctacatcagtacctagtctacgtaccaaccgttagtaagttacttttacggacttaaacttacctacgttactaaccaacgtaagttaaacctaaccgtaaccttacccccggtcggtccttaaccgtaccgggtttacgggaccgggttaacgggtaacccgtaagggttaggaacgttacgtaacgtaaacgtaacgtggtcggacttcgaaccgtaaccg

SEQ ID NO: 331145 - DNA, 607 bp, Homo sapiens
  misc_feature: GZ8MTXP01B8B30.17.57.F02.1.454.CMB.2.raw
  modified_base (223)..(223): a, c, t, g, unknown or other
  misc_feature (223)..(223): n is a, c, g, or t
  modified_base (553)..(553): a, c, t, g, unknown or other
  misc_feature (553)..(553): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctctgccgggnaagtcagagctattagacttaaacttttaatggtatcgaggcgggaaccagggaaacgcccctaaactcctagatctatactgctatacctaatttcgacgtaaaggttcgggggtacccctaagtcgtaacggtttccgaggttcgggactagggttgggtaacttcggtaggggaacctaggttacttttccactttcctaccacctaatcaagctagttctacgactaccgtggagttatttcgactaactttactacgtacgtacaacgtacgggttaccaccggttaccccgtattcgtttggacgacgggacaaggcgttaganacgtaacgaacgttcgttgttcggctcgaacctactacttcgttcttcttaacc

SEQ ID NO: 331146 - DNA, 593 bp, Homo sapiens
  misc_feature: GZ8MTXP01COD6N.17.57.F02.1.454.CMB.2.raw
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
  modified_base (379)..(379): a, c, t, g, unknown or other
  misc_feature (379)..(379): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctggccggganaagtcagagctattagacttaactttaatggtatcgaggacgggaaaccagggaaacncccctaaactcctagatctactactgctatccaatttcgacgtaaaaggtcgggtacctaagtacgtaaggttcaggtggacaggtggatcggngggacagtactttcactctcacagtcagcacgtctcgactacgtgaaggttatttacgacttaactttactactacgtactaacgtacggttaccgtacgtaaccccgttacgtaccgttttcggcccgtaacggggtaacgacggtcgttacggaacgtaacgttaacgaaacgttacgtggtacggcgttacggacttaccgtcttcgttcg

SEQ ID NO: 331147 - DNA, 578 bp, Homo sapiens
  misc_feature: GZ8MTXP01CRS6G.17.57.F02.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (395)..(395): a, c, t, g, unknown or other
  misc_feature (395)..(395): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaaactttaaatggtatcagcgggaaaccagggaaacncccctaaatcctgatctatactgcatccaatttgactaaaggtcgggtacccatcgaaggttcagtggacaggtggatcgtagggacagtactttcactctcacatcagcagtcngcaactgagtatttcgactaacttactactagtacaaacgtagggttacaccggtaccccgtacgtacgttttcggaccggtaacgggggaacccaaggtccgttagggaaacgtacgttaaccgaaaaccggttaacgttgggtacggtccgtacggaccttaacctaacgttccgttaacg

SEQ ID NO: 331148 - DNA, 595 bp, Homo sapiens
  misc_feature: GZ8MTXP01BCNV0.17.57.F02.1.454.CMB.2.raw
  modified_base (427)..(427): a, c, t, g, unknown or other
  misc_feature (427)..(427): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatctcttggccgggacaagtcagagcattagacttaaattttaatggtatcgaggacgggaaaccgaagggaaaccgacccctaaactcctagtacttactaatactagctaactactaagtttcgacgtaaaggttccgggtaccagtacgtaacggttcaggtgactagtttaggacttcgtgggaactagtacttacactctaccacactcganctacgtctacgacaccgtagtacgttattacgacttaacttacgtactacgtacaacgttacgtaaccaccgttaccctattcgttacgggacgtacgggaccaagtcgagacagtaacgaagttcgttggttcgaactcgcctaactcgttcgtcgttctttaaccg

SEQ ID NO: 331149 - DNA, 673 bp, Homo sapiens
  misc_feature: GZ8MTXP01DFOKT.17.57.F02.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgaccccagtctccatcctccctgtctgcatctgtagganacagagtcacctatctctcggccgggnaaagtcaagagctaattacgtacttaaactttaaagtggtaactcgaaggaccgggaaaccgtaacgggaaacgaccccctaaaactcctagaatctaactacgtcactacttacctaaagtttcgaacgtaaagggtcggggtacccctagttaccgtaaggttcgaaggtggaactagggttggaacgttcggtagggtaacagtactttcaaccttctacaactatcgacgtactagtctgtacctaacgtgtaaggttactttacgaacttaacgttactaacgttgtaacaaacgtggttaacctaacggttacccgtagttaccgttacgggaccggtaaacggggaaccttaaggtccgttaaggtaacgacgttaaaacgaaaccgttacgtggtaaccgggtctacggacccgttacctaacgttccgtttaacg
